United States Patent
Xiao et al.

(10) Patent No.: US 9,920,121 B2
(45) Date of Patent: *Mar. 20, 2018

(54) ANTIBODIES TARGETING CDH19 FOR MELANOMA

(71) Applicant: AMGEN INC., Thousand Oaks, CA (US)

(72) Inventors: Shouhua Xiao, Foster City, CA (US); Zheng Pan, Fremont, CA (US); Dineli Wickramasinghe, San Francisco, CA (US); M. Shawn Jeffries, Indianapolis, IN (US); Chadwick Terence King, North Vancouver (CA); Brian Mingtung Chan, Port Coquitlam (CA)

(73) Assignee: AMGEN INC., Thousand Oaks, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/762,053

(22) PCT Filed: Jan. 27, 2014

(86) PCT No.: PCT/EP2014/051551
§ 371 (c)(1),
(2) Date: Jul. 20, 2015

(87) PCT Pub. No.: WO2014/114801
PCT Pub. Date: Jul. 31, 2014

(65) Prior Publication Data
US 2015/0322151 A1    Nov. 12, 2015

Related U.S. Application Data

(60) Provisional application No. 61/756,977, filed on Jan. 25, 2013, provisional application No. 61/785,119, filed on Mar. 14, 2013.

(51) Int. Cl.
| | |
|---|---|
| *A61K 39/395* | (2006.01) |
| *C07K 16/28* | (2006.01) |
| *C07K 16/30* | (2006.01) |
| *A61K 47/68* | (2017.01) |
| *A61K 39/00* | (2006.01) |

(52) U.S. Cl.
CPC ........ *C07K 16/28* (2013.01); *A61K 47/6803* (2017.08); *A61K 47/6849* (2017.08); *A61K 47/6865* (2017.08); *C07K 16/3053* (2013.01); *A61K 2039/505* (2013.01); *C07K 2317/21* (2013.01); *C07K 2317/33* (2013.01); *C07K 2317/34* (2013.01); *C07K 2317/55* (2013.01); *C07K 2317/73* (2013.01); *C07K 2317/77* (2013.01); *C07K 2317/92* (2013.01)

(58) Field of Classification Search
None
See application file for complete search history.

(56) References Cited

U.S. PATENT DOCUMENTS

2005/0276812 A1\* 12/2005 Ebens, Jr. ........ A61K 47/48384
424/178.1

FOREIGN PATENT DOCUMENTS

| | | | |
|---|---|---|---|
| WO | WO-2006/071441 A2 | | 7/2006 |
| WO | 2011/005481 | \* | 1/2011 |

OTHER PUBLICATIONS

Anti-CDH19 Product Datasheet, <<https://atlasantibodies.com/print_datasheet/R74953>> retrieved May 13, 2014.
Bertucci et al., Gene expression profiling of human melanoma cell lines with distinct metastatic potential identifies new progession markers. *Int. J. Cancer Res. Treatment*, 27(5A): 3441-9 (2007).
CDH19 monoclonal antibody (M01), clone 1G4, <<http://www.abnova.com/protocol_pdf/DS_H00028513-M01.pdf>> retrieved May 13, 2014.
Chen et al., The melanosomal protein PMEL17 as a target for antibody drug conjugate therapy in melanoma. *J. Biol. Chem.* 287(29): 24082-91 (2012).
Niu et al., Monocyte chemotactic protein (MCP)-1 promotes angiogenesis via a novel transcription factor, MCP-1 induced protein (MCPIP). *J. Biol. Chem.* 283(21): 14542-51 (2008).

\* cited by examiner

*Primary Examiner* — Sheela J. Huff
(74) *Attorney, Agent, or Firm* — Marshall, Gerstein & Borun LLP

(57) ABSTRACT

The present disclosure provides a human antibody or antigen binding fragment thereof or an antibody construct comprising a human binding domain or antigen binding fragment thereof capable of binding to human CDH19 on the surface of a target cell. The disclosure relates to a nucleic acid sequence encoding the antibody or antigen binding fragment thereof contained in the antibody construct, a vector comprising the nucleic acid sequence and a host cell transformed or transfected with the vector. Furthermore, the disclosure relates to a process for the production of the antibody construct of the disclosure, a medical use or a method of treatment using the antibody construct and a kit comprising the antibody or antigen binding fragment thereof or the antibody construct.

25 Claims, 12 Drawing Sheets

ANTIBODIES TARGETING CDH19 FOR MELANOMA

RELATED APPLICATIONS

This application is related to a U.S. provisional application entitled "Antibody constructs for CDH19 and CD3," filed on Mar. 15, 2013, the same day as the present application is filed. This related application is incorporated in its entirety by reference.

FIELD OF THE INVENTION

The present invention relates to compositions of antigen binding proteins including antibodies capable of binding to human CDH19 on the surface of a target cell, as well as related methods. Moreover, the invention provides a nucleic acid sequence encoding the antibody construct, a vector comprising the nucleic acid sequence and a host cell transformed or transfected with the nucleic acid sequence or a vector comprising the nucleic acid sequence. Furthermore, the invention provides a process for the production of the antibody of the invention, a method of treatment using the antibody and a kit comprising the antibody.

BACKGROUND OF THE INVENTION

Melanoma is a skin cancer that is caused by the oncogenic transformation of melanocytes, which are pigment producing skin cells. As of 2009, Melanoma had a prevalence of more than 870,000 cases in the US alone (US National Institutes of Health). Each year, over 75,000 new cases of melanoma are diagnosed in the US, and approximately 25% of patients have advanced disease at the time of diagnosis. Despite the fact that cases of primary melanoma can be cured by surgery if they are detected early enough, melanoma is the leading cause of death from skin disease in the US, responsible for about 10,000 deaths per year in the US. Once the disease has spread and became metastatic, the prognosis is poor, with a 5 year relative survival of 15%.

There are four basic types of melanomas. Three types are found in the top layers of the skin and the fourth one is invasive and has penetrated deeper into the skin and may have spread to other areas of the body.

Superficial spreading melanoma is the most common type of melanoma which accounts for about 70% of all cases. It grows along the top layer of the skin for a fairly long time before penetrating more deeply. It first appears as a flat or slightly raised discolored patch that has irregular borders and may be somewhat asymmetrical in form. The color varies, and you may see areas of tan, brown, black, red, blue or white. This type of melanoma can occur in a previously benign mole and is found most often in young people.

Lentigo maligna is similar to the superficial spreading type, as it also remains close to the skin surface for quite a while, and usually appears as a flat or mildly elevated mottled tan, brown or dark brown discoloration. It is found most often in the elderly. When this cancer becomes invasive, it is referred to as lentigo maligna melanoma.

Acral lentiginous melanoma also spreads superficially before penetrating more deeply. It is quite different from the others, though, as it usually appears as a black or brown discoloration under the nails or on the soles of the feet or palms of the hands. This type of melanoma is sometimes found on dark-skinned people, and can often advance more quickly than superficial spreading melanoma and lentigo maligna.

Nodular melanoma is usually invasive at the time it is first diagnosed. The malignancy is recognized when it becomes a bump. It is usually black, but occasionally is blue, gray, white, brown, tan, red or skin tone. This is the most aggressive of the melanomas, and is found in 10 to 15 percent of cases.

Common treatments for metastatic melanoma include chemotherapy, targeted therapies for eligible patients (e.g. BRAF inhibitor treatment for patients with BRAF mutations) and immunotherapy. Metastatic melanoma is a tumor type where immunotherapy has been demonstrated to not only slow disease progression, but to lead to cures in late stage patients. Interleukin-2 was approved for the use in metastatic melanoma in 1998, and in 2011 an antibody targeting CTLA4, a member of a new generation of immune checkpoint inhibitors, gained approval by the FDA.

CDH19 is a type II cadherin transmembrane protein of unknown function. The human gene was cloned in 2000 based on its sequence similarity to CDH7 (Kools, P. et al. Genomics. 2000). Expressed Sequence Tags (ESTs) for CDH19 were isolated from melanocyte cDNA libraries, indicating that expression of CDH19 may be limited to cells of neural crest origin (Kools, P. et al. Genomics. 2000). In support of this notion, rat CDH19 was found to be expressed primarily in nerve ganglia and in Schwann cells during rat embryonic development (Takahashi, M. and Osumi, O. Devl Dynamics. 2005.).

Diagnostic antibodies detecting CDH19 in Western Blot, immunohistochemitstry or flow cytometry are known in the art and commercially available. Those antibodies comprise poly- and monoclonal antibodies generated in animal hosts.

SUMMARY OF THE INVENTION

The present invention provides an isolated human antibody or antigen binding fragment thereof capable of binding to human CDH19 on the surface of a target cell. In a preferred embodiment the antibody or antigen binding fragment thereof comprises a monoclonal antibody or a fragment thereof.

In one embodiment the human antibody or antigen binding fragment thereof of the invention comprises a human binding domain or antigen binding fragment thereof comprising CDR-H1, CDR-H2 and CDR-H3 and a VL region comprising CDR-L1, CDR-L2 and CDR-L3 selected from the group consisting of:
(a) CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 222, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 252, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 82, CDR-H2 as depicted in SEQ ID NO: 83, CDR-H3 as depicted in SEQ ID NO: 909, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 926, and CDR-H1 as depicted in SEQ ID NO: 52, CDR-H2 as depicted in SEQ ID NO: 53, CDR-H3 as depicted in SEQ ID NO: 904, CDR-L1 as depicted in SEQ ID NO: 220, CDR-L2 as depicted in SEQ ID NO: 221 and CDR-L3 as depicted in SEQ ID NO: 926;

(b) CDR-H1 as depicted in SEQ ID NO: 124, CDR-H2 as depicted in SEQ ID NO: 125, CDR-H3 as depicted in SEQ ID NO: 126, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 300, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 306, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 312, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 928, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 929, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 942, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 943, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 937, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 148, CDR-H2 as depicted in SEQ ID NO: 149, CDR-H3 as depicted in SEQ ID NO: 919, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 936, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 933, CDR-H1 as depicted in SEQ ID NO: 136, CDR-H2 as depicted in SEQ ID NO: 137, CDR-H3 as depicted in SEQ ID NO: 917, CDR-L1 as depicted in SEQ ID NO: 304, CDR-L2 as depicted in SEQ ID NO: 305 and CDR-L3 as depicted in SEQ ID NO: 934, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 930, CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 931, and CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 932;

(c) CDR-H1 as depicted in SEQ ID NO: 94, CDR-H2 as depicted in SEQ ID NO: 95, CDR-H3 as depicted in SEQ ID NO: 96, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 100, CDR-H2 as depicted in SEQ ID NO: 101, CDR-H3 as depicted in SEQ ID NO: 102, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 154, CDR-H2 as depicted in SEQ ID NO: 155, CDR-H3 as depicted in SEQ ID NO: 156, CDR-L1 as depicted in SEQ ID NO: 322, CDR-L2 as depicted in SEQ ID NO: 323 and CDR-L3 as depicted in SEQ ID NO: 324, CDR-H1 as depicted in SEQ ID NO: 100, CDR-H2 as depicted in SEQ ID NO: 101, CDR-H3 as depicted in SEQ ID NO: 912, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 100, CDR-H2 as depicted in SEQ ID NO: 101, CDR-H3 as depicted in SEQ ID NO: 913, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 94, CDR-H2 as depicted in SEQ ID NO: 95, CDR-H3 as depicted in SEQ ID NO: 910, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 94, CDR-H2 as depicted in SEQ ID NO: 95, CDR-H3 as depicted in SEQ ID NO: 911, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 118, CDR-H2 as depicted in SEQ ID NO: 914, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, and CDR-H1 as depicted in SEQ ID NO: 154, CDR-H2 as depicted in SEQ ID NO: 155, CDR-H3 as depicted in SEQ ID NO: 920, CDR-L1 as depicted in SEQ ID NO: 322, CDR-L2 as depicted in SEQ ID NO: 323 and CDR-L3 as depicted in SEQ ID NO: 324;

(d) CDR-H1 as depicted in SEQ ID NO: 4, CDR-H2 as depicted in SEQ ID NO: 5, CDR-H3 as depicted in SEQ ID NO: 6, CDR-L1 as depicted in SEQ ID NO: 172, CDR-L2 as depicted in SEQ ID NO: 173 and CDR-L3 as depicted in SEQ ID NO: 174, CDR-H1 as depicted in SEQ ID NO: 10, CDR-H2 as depicted in SEQ ID NO: 11, CDR-H3 as depicted in SEQ ID NO: 12, CDR-L1 as depicted in SEQ ID NO: 178, CDR-L2 as depicted in SEQ ID NO: 179 and CDR-L3 as depicted in SEQ ID NO: 180, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 198, CDR-H1 as depicted in SEQ ID NO: 34, CDR-H2 as depicted in SEQ ID NO: 35, CDR-H3 as depicted in SEQ ID NO: 36, CDR-L1 as depicted in SEQ ID NO: 202, CDR-L2 as depicted in SEQ ID NO: 203 and CDR-L3 as depicted in SEQ ID NO: 204, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 214, CDR-L2 as depicted in SEQ ID NO: 215 and CDR-L3 as depicted in SEQ ID NO: 216, CDR-H1 as depicted in SEQ ID NO: 58, CDR-H2 as depicted in SEQ ID NO: 59, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 64, CDR-H2 as depicted in SEQ ID NO: 65, CDR-H3 as depicted in SEQ ID NO: 66, CDR-L1 as depicted in SEQ ID NO: 232, CDR-L2 as depicted in SEQ ID NO: 233 and CDR-L3 as depicted in SEQ ID NO: 234, CDR-H1 as depicted in SEQ ID NO: 70, CDR-H2 as depicted in SEQ ID NO: 71, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 328, CDR-L2 as depicted in SEQ ID NO: 329 and CDR-L3 as depicted in SEQ ID NO: 330, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 902, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 903, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 925, CDR-L2 as depicted in SEQ ID NO: 215 and CDR-L3 as depicted in SEQ ID NO: 216, CDR-H1 as depicted in SEQ ID NO: 70, CDR-H2 as depicted in SEQ ID NO: 907, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 70, CDR-H2 as depicted in SEQ ID NO: 907, CDR-H3 as depicted in SEQ ID NO: 908, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 58, CDR-H2 as depicted in SEQ ID NO: 905, CDR-H3 as depicted in SEQ ID NO: 906, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 58, CDR-H2 as depicted in SEQ ID NO: 905, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 330, CDR-H1 as depicted in SEQ ID NO: 160, CDR-H2 as depicted in SEQ ID NO: 921, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 940, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 941, CDR-L2 as depicted in SEQ ID NO: 329 and CDR-L3 as depicted in SEQ ID NO: 330, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, and CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 939, CDR-L2 as depicted in SEQ ID NO: 329 and CDR-L3 as depicted in SEQ ID NO: 330; and (e) CDR-H1 as depicted in SEQ ID NO: 76, CDR-H2 as depicted in SEQ ID NO: 77, CDR-H3 as depicted in SEQ ID NO: 78, CDR-L1 as depicted in SEQ ID NO: 244, CDR-L2 as depicted in SEQ ID NO: 245 and CDR-L3 as depicted in SEQ ID NO: 246, CDR-H1 as depicted in SEQ ID NO: 88, CDR-H2 as depicted in SEQ ID NO: 89, CDR-H3 as depicted in SEQ ID NO: 90, CDR-L1 as depicted in SEQ ID NO: 256, CDR-L2 as depicted in SEQ ID NO: 257 and CDR-L3 as depicted in SEQ ID NO: 258, CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276, CDR-H1 as depicted in SEQ ID NO: 112, CDR-H2 as depicted in SEQ ID NO: 113, CDR-H3 as depicted in SEQ ID NO: 114, CDR-L1 as depicted in SEQ ID NO: 280, CDR-L2 as depicted in SEQ ID NO: 281 and CDR-L3 as depicted in SEQ ID NO: 282, and CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276.

In a further embodiment of the human antibody or antigen binding fragment thereof of the invention the human binding domain or antigen binding fragment thereof comprises a VH region selected from the group consisting of VH regions (a) as depicted in SEQ ID NO: 362, SEQ ID NO: 364, SEQ ID NO: 485, SEQ ID NO: 486, SEQ ID NO: 487, SEQ ID NO: 492, SEQ ID NO: 493, SEQ ID NO: 494, and SEQ ID NO: 495;

(b) as depicted in SEQ ID NO: 342, SEQ ID NO: 366, SEQ ID NO: 370, SEQ ID NO: 344, SEQ ID NO: 372, SEQ ID NO: 368, SEQ ID NO: 496, SEQ ID NO: 497, SEQ ID NO: 498, SEQ ID NO: 499, SEQ ID NO: 500, SEQ ID NO: 508, SEQ ID NO: 509, SEQ ID NO: 510, SEQ ID NO: 511, SEQ ID NO: 512, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, and SEQ ID NO: 538;

(c) as depicted in SEQ ID NO: 338, SEQ ID NO: 354, SEQ ID NO: 378, SEQ ID NO: 356, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 501, SEQ ID NO: 502, SEQ ID NO: 503, SEQ ID NO: 504, SEQ ID NO: 505, SEQ ID NO: 506, SEQ ID NO: 517, and SEQ ID NO: 518;

(d) as depicted in SEQ ID NO: 352, SEQ ID NO: 360, SEQ ID NO: 388, SEQ ID NO: 386, SEQ ID NO: 340, SEQ ID NO: 346, SEQ ID NO: 374, SEQ ID NO: 348, SEQ ID NO: 390, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 488, SEQ ID NO: 489, SEQ ID NO: 490, SEQ ID NO: 491, SEQ ID NO: 513, SEQ ID NO: 514, SEQ ID NO: 515, SEQ ID NO: 516, SEQ ID NO: 540, SEQ ID NO: 541, SEQ ID NO: 542, and SEQ ID NO: 543; and (e) as depicted in SEQ ID NO: 376, SEQ ID NO: 392, SEQ ID NO: 358, SEQ ID NO: 350, and SEQ ID NO: 507.

In another embodiment the human antibody or antigen binding fragment thereof of the invention comprises the human binding domain or antigen binding fragment thereof comprising a VL region selected from the group consisting of VL regions (a) as depicted in SEQ ID NO: 418, SEQ ID NO: 420, SEQ ID NO: 580, SEQ ID NO: 581, SEQ ID NO: 582, SEQ ID NO: 587, SEQ ID NO: 588, SEQ ID NO: 589, and SEQ ID NO: 590;

(b) as depicted in SEQ ID NO: 398, SEQ ID NO: 422, SEQ ID NO: 426, SEQ ID NO: 400, SEQ ID NO: 428, SEQ ID NO: 424, SEQ ID NO: 591, SEQ ID NO: 592, SEQ ID NO: 593, SEQ ID NO: 594, SEQ ID NO: 595, SEQ ID NO: 603, SEQ ID NO: 604, SEQ ID NO: 605, SEQ ID NO: 606, SEQ ID NO: 607, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, and SEQ ID NO: 633;

(c) as depicted in SEQ ID NO: 394, SEQ ID NO: 410, SEQ ID NO: 434, SEQ ID NO: 412, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 596, SEQ ID NO: 597, SEQ ID NO: 598, SEQ ID NO: 599, SEQ ID NO: 600, SEQ ID NO: 601, SEQ ID NO: 612, and SEQ ID NO: 613;

(d) as depicted in SEQ ID NO: 408, SEQ ID NO: 416, SEQ ID NO: 444, SEQ ID NO: 442, SEQ ID NO: 396, SEQ ID NO: 402, SEQ ID NO: 430, SEQ ID NO: 404, SEQ ID NO: 446, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 583, SEQ ID NO: 584, SEQ ID NO: 585, SEQ ID NO: 586, SEQ ID NO: 608, SEQ ID NO: 609, SEQ ID NO: 610, SEQ ID NO: 611, SEQ ID NO: 635, SEQ ID NO: 636, SEQ ID NO: 637, and SEQ ID NO: 638; and (e) as depicted in SEQ ID NO: 432, SEQ ID NO: 448, SEQ ID NO: 414, SEQ ID NO: 406, and SEQ ID NO: 602.

The invention further provides an embodiment of the human antibody or antigen binding fragment thereof of the invention, wherein the human binding domain or antigen binding fragment thereof comprises a VH region and a VL region selected from the group consisting of:

(1) pairs of a VH region and a VL region as depicted in SEQ ID NOs: 362+418, SEQ ID NOs: 364+420, SEQ ID NOs: 485+580, SEQ ID NOs: 486+581, SEQ ID NOs: 487+582, SEQ ID NOs: 492+587, SEQ ID NOs: 493+588, SEQ ID NOs: 494+589, and SEQ ID NOs: 495+590;

(2) pairs of a VH region and a VL region as depicted in SEQ ID NOs: 342+398, SEQ ID NOs: 366+422, SEQ ID NOs: 370+426, SEQ ID NOs: 344+400, SEQ ID NOs: 372+428, SEQ ID NOs: 368+424, SEQ ID NOs: 496+591, SEQ ID NOs: 497+592, SEQ ID NOs: 498+593, SEQ ID NOs: 499+594, SEQ ID NOs: 500+595, SEQ ID NOs: 508+603, SEQ ID NOs: 509+604, SEQ ID NOs: 510+605, SEQ ID NOs: 511+606, SEQ ID NOs: 512+607, SEQ ID NOs: 519+614, SEQ ID NOs: 520+615, SEQ ID NOs: 521+616, SEQ ID NOs: 522+617, SEQ ID NOs: 523+618, SEQ ID NOs: 524+619, SEQ ID NOs: 525+620, SEQ ID NOs: 526+621, SEQ ID NOs: 527+622, SEQ ID NOs: 528+623, SEQ ID NOs: 529+624, SEQ ID NOs: 530+625, SEQ ID NOs: 531+626, SEQ ID NOs: 532+627, SEQ ID NOs: 533+628, SEQ ID NOs: 534+629, SEQ ID NOs: 535+630, SEQ ID NOs: 536+631, SEQ ID NOs: 537+632, and SEQ ID NOs: 538+633;

(3) pairs of a VH region and a VL region as depicted in SEQ ID NOs: 338+394, SEQ ID NOs: 354+410, SEQ ID NOs: 378+434, SEQ ID NOs: 356+412, SEQ ID NOs: 476+571, SEQ ID NOs: 477+572, SEQ ID NOs: 478+573, SEQ ID NOs: 479+574, SEQ ID NOs: 480+575, SEQ ID NOs: 481+576, SEQ ID NOs: 482+577, SEQ ID NOs: 483+578, SEQ ID NOs: 484+579, SEQ ID NOs: 501+596, SEQ ID NOs: 502+597, SEQ ID NOs: 503+598, SEQ ID NOs: 504+599, SEQ ID NOs: 505+600, SEQ ID NOs: 506+601, SEQ ID NOs: 517+612, and SEQ ID NOs: 518+613;

(4) pairs of a VH region and a VL region as depicted in SEQ ID NOs: 352+408, SEQ ID NOs: 360+416, SEQ ID NOs: 388+444, SEQ ID NOs: 386+442, SEQ ID NOs: 340+396, SEQ ID NOs: 346+402, SEQ ID NOs: 374+430, SEQ ID NOs: 348+404, SEQ ID NOs: 390+446, SEQ ID NOs: 463+558, SEQ ID NOs: 464+559, SEQ ID NOs: 465+560, SEQ ID NOs: 466+561, SEQ ID NOs: 467+562, SEQ ID NOs: 468+563, SEQ ID NOs: 469+564, SEQ ID NOs: 470+565, SEQ ID NOs: 471+566, SEQ ID NOs: 472+567, SEQ ID NOs: 473+568, SEQ ID NOs: 474+569, SEQ ID NOs: 475+570, SEQ ID NOs: 488+583, SEQ ID NOs: 489+584, SEQ ID NOs: 490+585, SEQ ID NOs: 491+586, SEQ ID NOs: 513+608, SEQ ID NOs: 514+609, SEQ ID NOs: 515+610, SEQ ID NOs: 516+611, SEQ ID NOs: 540+635, SEQ ID NOs: 541+636, SEQ ID NOs: 542+637, and SEQ ID NOs: 543+638; and (5) pairs of a VH region and a VL region as depicted in SEQ ID NOs: 376+432, SEQ ID NOs: 392+448, SEQ ID NOs: 358+414, SEQ ID NOs: 350+406, and SEQ ID NOs: 507+602.

In a further embodiment the human binding domain or antigen binding fragment thereof comprises the groups of heavy and light chains having an amino acid sequence selected from the group consisting of (1) a heavy and light chain as depicted in SEQ ID NOs: 644+680, SEQ ID NOs: 650+686, SEQ ID NOs: 747+842, SEQ ID NOs: 748+843, SEQ ID NOs: 749+844, SEQ ID NOs: 754+849, SEQ ID NOs: 755+850, SEQ ID NOs: 756+851, and SEQ ID NOs: 757+852;

(2) a heavy and light chain as depicted in SEQ ID NOs: 660+696, SEQ ID NOs: 662+698, SEQ ID NOs: 668+704, SEQ ID NOs: 674+710, SEQ ID NOs: 672+708, SEQ ID NOs: 658+694, SEQ ID NOs: 758+853, SEQ ID NOs: 759+854, SEQ ID NOs: 760+855, SEQ ID NOs: 761+856, SEQ ID NOs: 762+857, SEQ ID NOs: 770+865, SEQ ID NOs: 771+866, SEQ ID NOs: 772+867, SEQ ID NOs: 773+868, SEQ ID NOs: 774+869, SEQ ID NOs: 781+876, SEQ ID NOs: 782+877, SEQ ID NOs: 783+878, SEQ ID NOs: 784+879, SEQ ID NOs: 785+880, SEQ ID NOs: 786+881, SEQ ID NOs: 787+882, SEQ ID NOs: 788+883, SEQ ID NOs: 789+884, SEQ ID NOs: 790+885, SEQ ID NOs: 791+886, SEQ ID NOs: 792+887, SEQ ID NOs: 793+888, SEQ ID NOs: 794+889, SEQ ID NOs: 795+890, SEQ ID NOs: 796+891, SEQ ID NOs: 797+892, SEQ ID NOs: 798+893, SEQ ID NOs: 799+894, and SEQ ID NOs: 800+895;

(3) a heavy and light chain as depicted in SEQ ID NOs: 656+692, SEQ ID NOs: 654+690, SEQ ID NOs: 664+700, SEQ ID NOs: 670+706, SEQ ID NOs: 738+833, SEQ ID NOs: 739+834, SEQ ID NOs: 740+835, SEQ ID NOs: 741+836, SEQ ID NOs: 742+837, SEQ ID NOs: 743+838, SEQ ID NOs: 744+839, SEQ ID NOs: 745+840, SEQ ID NOs: 746+841, SEQ ID NOs: 763+858, SEQ ID NOs: 764+859, SEQ ID NOs: 765+860, SEQ ID NOs: 766+861, SEQ ID NOs: 767+862, SEQ ID NOs: 768+863, SEQ ID NOs: 779+874, and SEQ ID NOs: 780+875;

(4) a heavy and light chain as depicted in SEQ ID NOs: 640+676, SEQ ID NOs: 642+678, SEQ ID NOs: 646+682, SEQ ID NOs: 648+684, SEQ ID NOs: 666+702, SEQ ID NOs: 725+820, SEQ ID NOs: 726+821, SEQ ID NOs: 727+822, SEQ ID NOs: 728+823, SEQ ID NOs: 729+824, SEQ ID NOs: 730+825, SEQ ID NOs: 731+826, SEQ ID NOs: 732+827, SEQ ID NOs: 733+828, SEQ ID NOs: 734+829, SEQ ID NOs: 735+830, SEQ ID NOs: 736+831, SEQ ID NOs: 737+832, SEQ ID NOs: 750+845, SEQ ID NOs: 751+846, SEQ ID NOs: 752+847, SEQ ID NOs: 753+848, SEQ ID NOs: 775+870, SEQ ID NOs: 776+871, SEQ ID NOs: 777+872, SEQ ID NOs: 778+873, SEQ ID NOs: 802+897, SEQ ID NOs: 803+898, SEQ ID NOs: 804+899, and SEQ ID NOs: 805+900; and (5) a heavy and light chain as depicted in SEQ ID NOs: 652+688, and SEQ ID NOs: 769+864.

In another embodiment the invention is directed to an antibody construct comprising the human antibody or antigen binding fragment thereof capable of binding to human CDH19 on the surface of a target cell as described above that is conjugated to a chemotherapeutic agent.

In one embodiment of the antibody construct of the invention a linker conjugates the chemotherapeutic agent to the human antibody or antigen binding fragment thereof.

In a preferred embodiment of the antibody construct of the invention the linker is a non-cleavable linker.

It is also preferred that the linker in the antibody construct of the invention comprises MCC. In a further embodiment of the antibody construct of the invention the chemotherapeutic agent is conjugated to one or more lysines contained in the human antibody or antigen binding fragment thereof.

In one embodiment of the antibody construct of the invention the chemotherapeutic agent is DM1.

In a preferred embodiment of the antibody construct of the invention the average number of DM1 molecules per antibody construct is between 1 and 10.

It is also preferred for the antibody construct of the invention that the average number of DM1 molecules per antibody construct is between 3 and 7.

Moreover, it is preferred for the antibody construct of the invention that the average number of DM1 molecules per antibody construct is between 4 and 6.

In a further alternative embodiment of the antibody construct of the invention the average number of DM1 molecules per antibody construct is about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0.

The invention further provides an isolated nucleic acid molecule or sequence encoding a human antibody or antigen binding fragment thereof of the invention.

Furthermore, the invention provides a vector comprising a nucleic acid sequence of the invention. Moreover, the invention provides a host cell transformed or transfected with the nucleic acid sequence of the invention or with a vector comprising the nucleic acid molecule.

In a further embodiment the invention provides a process for the production of a human antibody or an antigen binding fragment thereof of the invention, said process comprising culturing a host cell of the invention under conditions allowing the expression of the human antibody or antigen binding fragment thereof of the invention and recovering the produced antibody or antigen binding fragment thereof from the culture.

In a further embodiment the invention provides a process for the production of an antibody construct comprising a human antibody or an antigen binding fragment thereof of the invention, said process comprising culturing a host cell of the invention under conditions allowing the expression of the human antibody or antigen binding fragment thereof of the invention and recovering the produced antibody or antigen binding fragment thereof from the culture, and conjugating a chemotherapeutic agent to the recovered antibody or antigen binding fragment thereof to produce the antibody conjugate.

Moreover, the invention provides a pharmaceutical composition comprising a human antibody or antigen binding fragment thereof of the invention or an antibody construct of the invention or produced according to the process of the invention in admixture with a pharmaceutically acceptable carrier thereof.

In one embodiment the invention provides the human antibody or antigen binding fragment thereof of the invention, the antibody construct of the invention, or produced according to the process of the invention for use in the prevention, treatment or amelioration of a melanoma disease or metastatic melanoma disease. Preferably, the melanoma disease or metastatic melanoma disease is selected from the group consisting of superficial spreading melanoma, lentigo maligna, lentigo maligna melanoma, acral lentiginous melanoma and nodular melanoma.

The invention also provides a method for the treatment or amelioration of a melanoma disease or metastatic melanoma disease, comprising the step of administering to a subject in need thereof the antibody or antigen binding fragment thereof of the invention, the antibody construct of the invention, an antibody or antigen binding fragment thereof of the invention or the antibody construct of the invention produced according to the process of the invention or a pharmaceutical composition of the invention.

In a preferred embodiment method the invention the melanoma disease or metastatic melanoma disease is selected from the group consisting of superficial spreading melanoma, lentigo maligna, lentigo maligna melanoma, acral lentiginous melanoma and nodular melanoma.

In a further embodiment, the invention provides a kit comprising an antibody or antigen binding fragment thereof of the invention, an antibody construct of the invention, an antibody or antigen binding fragment thereof of the invention or the antibody construct produced according to the process of the invention, a vector of the invention, and/or a host cell of the invention.

DETAILED DESCRIPTION OF THE INVENTION

Definitions

Figure 1:
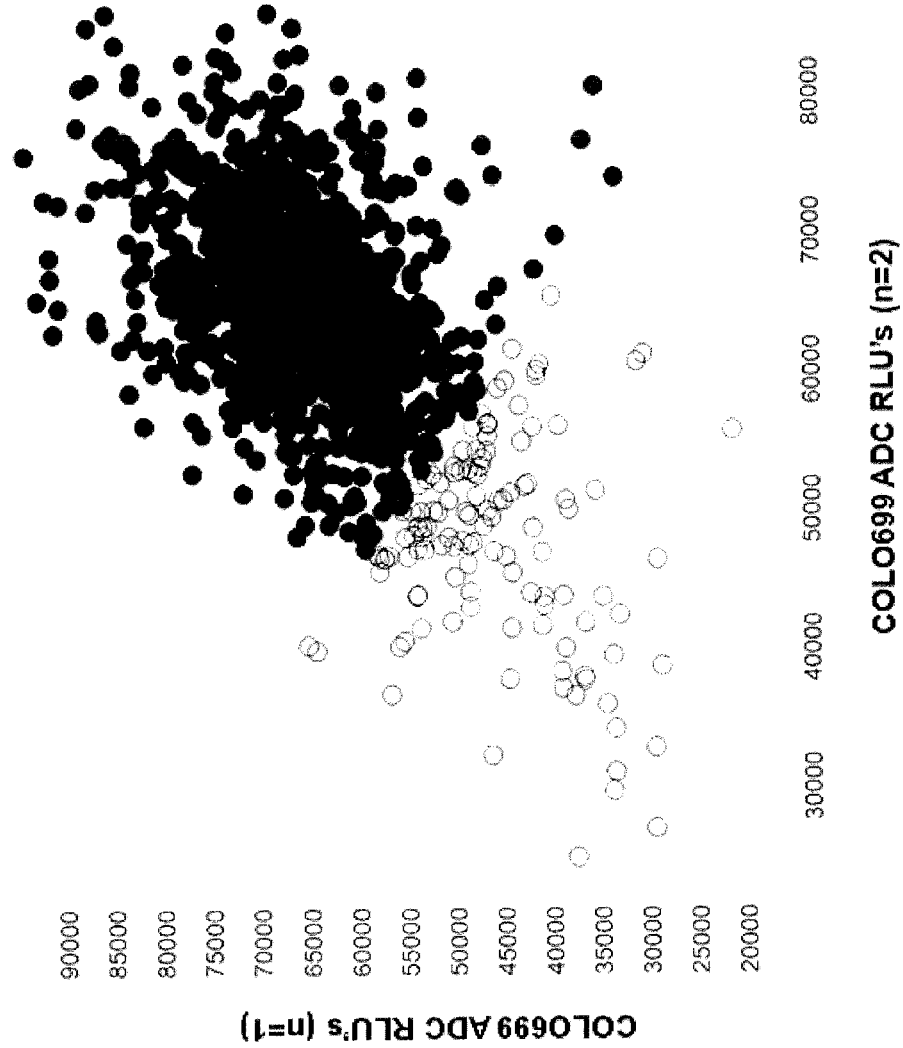
FIG. 1 depicts cell viability data of Colo-699 cells that have been treated with fully human anti-CDH19 antibodies and a high concentration of a goat anti-human Fc monovalent Fab conjugated with DM1 (DM1-Fab) at a drug-antibody ratio (DAR) (~1.3).

It must be noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

The definition of the term "antibody" includes embodiments such as monoclonal, chimeric, single chain, humanized and human antibodies, as well as antibody fragments, like, inter alia, Fab fragments. Antibody fragments or derivatives further comprise F(ab')$_2$, Fv, scFv fragments or single domain antibodies such as domain antibodies or nanobodies, single variable domain antibodies or immunoglobulin single variable domain comprising merely one variable domain, which might be VHH, VH or VL, that specifically bind an antigen or epitope independently of other V regions or domains; see, for example, Harlow and Lane (1988) and (1999), loc. cit.; Kontermann and Dübel, Antibody Engineering, Springer, 2nd ed. 2010 and Little, Recombinant Antibodies for Immunotherapy, Cambridge University Press 2009. Such immunoglobulin single variable domain encompasses not only an isolated antibody single variable domain polypeptide, but also larger polypeptides that comprise one or more monomers of an antibody single variable domain polypeptide sequence.

In line with this definition all above described embodiments of the term antibody can be subsumed under the term "antibody construct". Said term also includes diabodies or Dual-Affinity Re-Targeting (DART) antibodies. Further envisaged are (bispecific) single chain diabodies, tandem diabodies (Tandab's), "minibodies" exemplified by a structure which is as follows: (VH-VL-CH3)$_2$, (scFv-CH3)$_2$ or (scFv-CH3-scFv)$_2$, "Fc DART" antibodies and "IgG DART" antibodies, and multibodies such as triabodies. Immunoglobulin single variable domains encompass not only an isolated antibody single variable domain polypeptide, but also larger polypeptides that comprise one or more monomers of an antibody single variable domain polypeptide sequence.

Various procedures are known in the art and may be used for the production of such antibody constructs (antibodies and/or fragments). Thus, (antibody) derivatives can be produced by peptidomimetics. Further, techniques described for the production of single chain antibodies (see, inter alia, U.S. Pat. No. 4,946,778, Kontermann and Dübel (2010), loc. cit. and Little (2009), loc. cit.) can be adapted to produce single chain antibodies specific for elected polypeptide(s). Also, transgenic animals may be used to express humanized antibodies specific for polypeptides and fusion proteins of this invention. For the preparation of monoclonal antibodies, any technique, providing antibodies produced by continuous cell line cultures can be used. Examples for such techniques include the hybridoma technique (Köhler and Milstein Nature 256 (1975), 495-497), the trioma technique, the human B-cell hybridoma technique (Kozbor, Immunology Today 4 (1983), 72) and the EBV-hybridoma technique to produce human monoclonal antibodies (Cole et al., Monoclonal Antibodies and Cancer Therapy, Alan R. Liss, Inc. (1985), 77-96). Surface plasmon resonance as employed in the BIAcore system can be used to increase the efficiency of phage antibodies which bind to an epitope of a target polypeptide, such as CDH19 (Schier, Human Antibodies Hybridomas 7 (1996), 97-105; Malmborg, J. Immunol. Methods 183 (1995), 7-13). It is also envisaged in the context of this invention that the term "antibody" comprises antibody constructs, which may be expressed in a host as described herein below, e.g. antibody constructs which may be transfected and/or transduced via, inter alia, viruses or plasmid vectors.

Furthermore, the term "antibody" as employed in the invention also relates to derivatives or variants of the antibodies described herein which display the same specificity as the described antibodies. Accordingly, the term "antibody" also subsumes antibody constructs such as different types of fragments of antibodies, which still are characterized by the feature of specific binding for CDH19.

The terms "antigen-binding domain", "antigen-binding fragment" and "antibody binding region" when used herein refer to a part of an antibody molecule that comprises amino acids responsible for the specific binding between antibody and antigen. The part of the antigen that is specifically recognized and bound by the antibody is referred to as the "epitope" as described herein above. As mentioned above, an antigen-binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Examples of antigen-binding fragments of an antibody include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) a Fd fragment having the two VH and CH1 domains; (4) a Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv). Although the two domains of the Fv fragment, VL and VH are coded for by separate genes, they can be joined, using recombinant methods, by a synthetic linker that enables them to be made as a single protein chain in which the VL and VH regions pair to form monovalent molecules (known as single chain Fv (scFv); see e.g., Huston et al. (1988) Proc. Natl. Acad. Sci USA 85:5879-5883). These antibody fragments are obtained using conventional techniques known to those with skill in the art, and the fragments are evaluated for function in the same manner as are intact antibodies.

The term "monoclonal antibody" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In addition to their specificity, the monoclonal antibodies are advantageous in that they are synthesized by the hybridoma culture, uncontaminated by other immunoglobulins. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al., Nature, 256: 495 (1975), or may be made by recombinant DNA methods (see, e.g., U.S. Pat. No. 4,816,567). The "monoclonal antibodies" may also be isolated from phage antibody libraries using the techniques described in Clackson et al., Nature, 352: 624-628 (1991) and Marks et al., J. Mol. Biol., 222: 581-597 (1991), for example.

The term "human antibody" includes antibodies having variable and constant regions corresponding substantially to human germline immunoglobulin sequences known in the art, including, for example, those described by Kabat et al. (See Kabat et al. (1991) loc. cit.). The human antibodies of the invention may include amino acid residues not encoded by human germline immunoglobulin sequences (e.g., mutations introduced by random or site-specific mutagenesis in vitro or by somatic mutation in vivo), for example in the CDRs, and in particular, CDR3. The human antibody can have at least one, two, three, four, five, or more positions replaced with an amino acid residue that is not encoded by the human germline immunoglobulin sequence. It is emphasized that the definition of human antibodies as used herein also contemplates fully human antibodies, which include only non-artificially and/or genetically altered human sequences of antibodies as those can be derived by technologies using systems such as the Xenomice.

Examples of "antibody variants" include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function (s) (see, e.g., U.S. Pat. No. 5,648,260, Kontermann and Dübel (2010), loc. cit. and Little (2009), loc. cit.).

As used herein, "in vitro generated antibody" refers to an antibody where all or part of the variable region (e.g., at least one CDR) is generated in a non-immune cell selection (e.g., an in vitro phage display, protein chip or any other method in which candidate sequences can be tested for their ability to bind to an antigen). This term thus preferably excludes sequences generated by genomic rearrangement in an immune cell.

The pairing of a VH and VL together forms a single antigen-binding site. The CH domain most proximal to VH is designated as CH1. Each L chain is linked to an H chain by one covalent disulfide bond, while the two H chains are linked to each other by one or more disulfide bonds depending on the H chain isotype. The VH and VL domains consist of four regions of relatively conserved sequences called framework regions (FR1, FR2, FR3, and FR4), which form a scaffold for three regions of hypervariable sequences (complementarity determining regions, CDRs). The CDRs contain most of the residues responsible for specific interactions of the antibody with the antigen. CDRs are referred to as CDR 1, CDR2, and CDR3. Accordingly, CDR constituents on the heavy chain are referred to as H1, H2, and H3, while CDR constituents on the light chain are referred to as L1, L2, and L3.

The term "variable" refers to the portions of the immunoglobulin domains that exhibit variability in their sequence and that are involved in determining the specificity and binding affinity of a particular antibody (i.e., the "variable domain(s)"). Variability is not evenly distributed throughout the variable domains of antibodies; it is concentrated in sub-domains of each of the heavy and light chain variable regions. These sub-domains are called "hypervariable" regions or "complementarity determining regions" (CDRs). The more conserved (i.e., non-hypervariable) portions of the variable domains are called the "framework" regions (FRM). The variable domains of naturally occurring heavy and light chains each comprise four FRM regions, largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.). The constant domains are not directly involved in antigen binding, but exhibit various effector functions, such as, for example, antibody-dependent, cell-mediated cytotoxicity and complement activation.

The terms "CDR", and its plural "CDRs", refer to a complementarity determining region (CDR) of which three make up the binding character of a light chain variable region (CDRL1, CDRL2 and CDRL3) and three make up the binding character of a heavy chain variable region (CDRH1, CDRH2 and CDRH3). CDRs contribute to the functional activity of an antibody molecule and are separated by amino acid sequences that comprise scaffolding or framework regions. The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat, Chothia, and/or MacCallum (Kabat et al., loc. cit.; Chothia et al., J. Mol. Biol, 1987, 196: 901; and MacCallum et al., J. Mol. Biol, 1996, 262: 732). However, the numbering in accordance with the so-called Kabat system is preferred. The CDR3 of the light chain and, particularly, CDR3 of the heavy chain may constitute the most important determinants in antigen binding within the light and heavy chain variable regions. In some antibodies, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen.

In one embodiment, the antibody of the invention may comprise from one to six of the exemplary CDRs described herein. The antibodies of the invention may be of any type including IgM, IgG (including IgG1, IgG2, IgG3, IgG4), IgD, IgA, or IgE antibody. In a specific embodiment the antigen binding protein is an IgG type antibody, e.g., a IgG1 antibody.

In one embodiment, the antibody of the invention may be a multispecific antibody, and notably a bispecfic antibody, also sometimes referred to as "diabodies." These are antibodies that bind to two or more different antigens or different epitopes on a single antigen. In certain embodiments, a bispecific antibody binds CDH19 and an antigen on a human effector cell (e.g., T cell). Such antibodies are useful in targeting an effector cell response against a CDH19 expressing cells, such as a tumor cell. In preferred embodiments, the human effector cell antigen is CD3 (see corresponding formats e.g. in WO 2008/119567. Methods of making bispecific antibodies are known in the art. One such method involves engineering the Fc portion of the heavy chains such as to create "knobs" and "holes" which facilitate heterodimer formation of the heavy chains when co-expressed in a cell. U.S. Pat. No. 7,695,963. Another method also involves engineering the Fc portion of the heavy chain but uses electrostatic steering to encourage heterodimer formation while discouraging homodimer formation of the heavy chains when co-expressed in a cell. WO 2009/089004, which is incorporated herein by reference in its entirety.

In one embodiment, antibody of the invention is a minibody. Minibodies are minimized antibody-like proteins comprising a scFv joined to a CH3 domain. Hu et al., 1996, Cancer Res. 56:3055-3061.

In one embodiment, the antibody of the invention is a domain antibody; see, for example U.S. Pat. No. 6,248,516. Domain antibodies (dAbs) are functional binding domains of antibodies, corresponding to the variable regions of either the heavy (VH) or light (VL) chains of human antibodies. dABs have a molecular weight of approximately 13 kDa, or less than one-tenth the size of a full antibody. dABs are well expressed in a variety of hosts including bacterial, yeast, and mammalian cell systems. In addition, dAbs are highly stable and retain activity even after being subjected to harsh conditions, such as freeze-drying or heat denaturation. See, for example, U.S. Pat. Nos. 6,291,158; 6,582,915; 6,593,081; 6,172,197; US Serial No. 2004/0110941; European Patent 0368684; U.S. Pat. No. 6,696,245, WO04/058821, WO04/003019 and WO03/002609.

In one embodiment, the antibody of the invention is an antibody fragment, that is a fragment of any of the antibodies outlined herein that retain binding specificity to CDH19. In various embodiments, the antibody binding proteins comprise, but are not limited to, a F(ab), F(ab'), F(ab')2, Fv, or a single chain Fv fragments. At a minimum, an antibody, as meant herein, comprises a polypeptide that can bind specifically to CDH19 comprising all or part of a light or heavy chain variable region, such as one or more CDRs.

Naturally occurring antibodies typically include a signal sequence, which directs the antibody into the cellular pathway for protein secretion and which is typically not present in the mature antibody. A polynucleotide encoding an antibody of the invention may encode a naturally occurring a signal sequence or a heterologous signal sequence as described below.

"Consisting essentially of" means that the amino acid sequence can vary by about 1, 2, 3, 4, 5, 6, 7, 8, 9, 10, 11, 12, 13, 14, or 15% relative to the recited SEQ ID NO: sequence and still retain biological activity, as described herein.

In some embodiments, the antibodies of the invention are isolated proteins or substantially pure proteins. An "isolated" protein is unaccompanied by at least some of the material with which it is normally associated in its natural state, for example constituting at least about 5%, or at least about 50% by weight of the total protein in a given sample. It is understood that the isolated protein may constitute from 5 to 99.9% by weight of the total protein content depending on the circumstances. For example, the protein may be made at a significantly higher concentration through the use of an inducible promoter or high expression promoter, such that the protein is made at increased concentration levels. The definition includes the production of an antigen binding protein in a wide variety of organisms and/or host cells that are known in the art.

For amino acid sequences, sequence identity and/or similarity is determined by using standard techniques known in the art, including, but not limited to, the local sequence identity algorithm of Smith and Waterman, 1981, *Adv. Appl. Math.* 2:482, the sequence identity alignment algorithm of Needleman and Wunsch, 1970, *J. Mol. Biol.* 48:443, the search for similarity method of Pearson and Lipman, 1988, *Proc. Nat. Acad. Sci. U.S.A.* 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, *Nucl. Acid Res.* 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, *J. Mol. Evol.* 35:351-360; the method is similar to that described by Higgins and Sharp, 1989, *CABIOS* 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, *J. Mol. Biol.* 215:403-410; Altschul et al., 1997, *Nucleic Acids Res.* 25:3389-3402; and Karin et al., 1993, *Proc. Natl. Acad. Sci. U.S.A.* 90:5873-5787. A particularly useful BLAST program is the WU-BLAST-2 program which was obtained from Altschul et al., 1996, *Methods in Enzymology* 266:460-480. WU-BLAST-2 uses several search parameters, most of which are set to the default values. The adjustable parameters are set with the following values: overlap span=1, overlap fraction=0.125, word threshold (T)=11. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, Nucl. Acids Res. 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 80% to the sequences depicted herein, and more typically with preferably increasing homologies or identities of at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antigen binding protein. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 80%, and more typically with preferably increasing homologies or identities of at least 80%, 81%, 82%, 83%, 84%, 85%, 86%, 87%, 88%, 89%, 90%, 91%, 92%, 93%, 94%, 95%, 96%, 97%, 98%, or 99%, and almost 100%.

Thus, a "variant CDR" is one with the specified homology, similarity, or identity to the parent CDR of the invention, and shares biological function, including, but not limited to, at least 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

While the site or region for introducing an amino acid sequence variation is predetermined, the mutation per se need not be predetermined. For example, in order to optimize the performance of a mutation at a given site, random mutagenesis may be conducted at the target codon or region and the expressed antigen binding protein CDR variants screened for the optimal combination of desired activity. Techniques for making substitution mutations at predetermined sites in DNA having a known sequence are well known, for example, M13 primer mutagenesis and PCR mutagenesis. Screening of the mutants is done using assays of antigen binding protein activities, such as CDH19 binding.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

The term "hypervariable region" (also known as "complementarity determining regions" or CDRs) when used herein refers to the amino acid residues of an antibody which are (usually three or four short regions of extreme sequence variability) within the V-region domain of an immunoglobulin which form the antigen-binding site and are the main determinants of antigen specificity. There are at least two methods for identifying the CDR residues: (1) An approach based on cross-species sequence variability (i. e., Kabat et al., loc. cit.); and (2) An approach based on crystallographic studies of antigen-antibody complexes (Chothia, C. et al., J. Mol. Biol. 196: 901-917 (1987)). However, to the extent that two residue identification techniques define regions of overlapping, but not identical regions, they can be combined to define a hybrid CDR. However, in general, the CDR residues are preferably identified in accordance with the so-called Kabat (numbering) system.

The term "framework region" refers to the art-recognized portions of an antibody variable region that exist between the more divergent (i.e., hypervariable) CDRs. Such framework regions are typically referred to as frameworks 1 through 4 (FR1, FR2, FR3, and FR4) and provide a scaffold for the presentation of the six CDRs (three from the heavy chain and three from the light chain) in three dimensional space, to form an antigen-binding surface.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800, each of which is incorporated by reference in its entirety). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues. The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al and/or revealed by other techniques, for example, crystallography and two or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature.

CDR3 is typically the greatest source of molecular diversity within the antibody-binding site. H3, for example, can be as short as two amino acid residues or greater than 26 amino acids. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988. One of skill in the art will recognize that each subunit structure, e.g., a CH, VH, CL, VL, CDR, FR structure, comprises active fragments, e.g., the portion of the VH, VL, or CDR subunit the binds to the antigen, i.e., the antigen-binding fragment, or, e.g., the portion of the CH subunit that binds to and/or activates, e.g., an Fc receptor and/or complement. The CDRs typically refer to the Kabat CDRs, as described in Sequences of Proteins of immunological Interest, US Department of Health and Human Services (1991), eds. Kabat et al. Another standard for characterizing the antigen binding site is to refer to the hypervariable loops as described by Chothia. See, e.g., Chothia, et al. (1987; J. Mol. Biol. 227:799-817); and Tomlinson et al. (1995) EMBO J. 14: 4628-4638. Still another standard is the AbM definition used by Oxford Molecular's AbM antibody modeling software. See, generally, e.g., Protein Sequence and Structure Analysis of Antibody Variable Domains. In: Antibody Engineering Lab Manual (Ed.: Duebel, S. and Kontermann, R., Springer-Verlag, Heidelberg). Embodiments described with respect to Kabat CDRs can alternatively be implemented using similar described relationships with respect to Chothia hypervariable loops or to the AbM-defined loops.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "binding molecule" or "antibody construct" in the sense of the present disclosure indicates any molecule capable of (specifically) binding to, interacting with or recognizing the target molecule CDH19. Such molecules or constructs may include proteinaceous parts and non-proteinaceous parts (e.g. chemical linkers or chemical cross-linking agents such as glutaraldehyde).

The term "multispecific" as used herein refers to a binding molecule which is an antibody construct and comprises at least a first and a second binding domain, wherein the first binding domain is capable of binding to one antigen or target, and the second binding domain is capable of binding to another antigen or target. Accordingly, antibody constructs according to the invention comprise at least a specificity for CDH19. The "antibody construct" of the invention also comprises multispecific binding molecules such as e.g. trispecific binding molecules, the latter ones including three binding domains.

It is also envisaged that the antibody construct of the invention has, in addition to its function to bind to the target molecules CDH19 and CD3, a further function. In this format, the antibody construct is a bi-, tri- or multifunctional antibody construct by targeting plasma cells through binding to CDH19, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as, e.g. a toxin or radionuclide, and/or means to enhance serum half-life, etc.

The term "binding domain" characterizes in connection with the present invention a domain which is capable of specifically binding to/interacting with a given target epitope or a given target site on the target molecule CDH19.

Binding domains can be derived from a binding domain donor such as for example an antibody. It is envisaged that a binding domain of the present invention comprises at least said part of any of the aforementioned binding domains that is required for binding to/interacting with a given target epitope or a given target site on the target molecule CDH19.

It is envisaged that the binding domain of the aforementioned binding domain donors is characterized by that part of these donors that is responsible for binding the respective target, i.e. when that part is removed from the binding domain donor, said donor loses its binding capability. "Loses" means a reduction of at least 50% of the binding capability when compared with the binding donor. Methods to map these binding sites are well known in the art—it is therefore within the standard knowledge of the skilled person to locate/map the binding site of a binding domain donor and, thereby, to "derive" said binding domain from the respective binding domain donors.

The term "epitope" refers to a site on an antigen to which a binding domain, such as an antibody or immunoglobulin or derivative or fragment of an antibody or of an immunoglobulin, specifically binds. An "epitope" is antigenic and thus the term epitope is sometimes also referred to herein as "antigenic structure" or "antigenic determinant". Thus, the binding domain is an "antigen-interaction-site". Said binding/interaction is also understood to define a "specific recognition". In one example, said binding domain which (specifically) binds to/interacts with a given target epitope or a given target site on the target molecule CDH19 is an antibody or immunoglobulin, and said binding domain is a VH and/or VL region of an antibody or of an immunoglobulin.

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigen for one of the binding domains is comprised within the CDH19 protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

Moreover, the provided examples describe a further method to characterize a given binding domain by way of binning, which includes a test whether the given binding domain binds to one or more epitope cluster(s) of a given protein, in particular CDH19.

As used herein, the term "epitope cluster" denotes the entirety of epitopes lying in a defined contiguous stretch of an antigen. An epitope cluster can comprise one, two or more epitopes. The concept of epitope cluster is also used in the characterization of the features of the antibody or antigen binding fragment thereof of the invention.

The terms "(capable of) binding to", "specifically recognizing", "directed to" and "reacting with" mean in accordance with this invention that a binding domain is capable of specifically interacting with one or more, preferably at least two, more preferably at least three and most preferably at least four amino acids of an epitope.

As used herein, the terms "specifically interacting", "specifically binding" or "specifically bind(s)" mean that a binding domain exhibits appreciable affinity for a particular protein or antigen and, generally, does not exhibit significant reactivity with proteins or antigens other than CDH19. "Appreciable affinity" includes binding with an affinity of about $10^{-6}$M (KD) or stronger. Preferably, binding is considered specific when binding affinity is about $10^{-12}$ to $10^{-8}$ M, $10^{-12}$ to $10^{-9}$ M, $10^{-12}$ to $10^{-10}$ M, $10^{-11}$ to $10^{-9}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than CDH19. Preferably, a binding domain of the invention does not essentially bind or is not capable of binding to proteins or antigens other than CDH19.

The term "does not essentially bind", or "is not capable of binding" means that a binding domain of the present invention does not bind another protein or antigen other than CDH19, i.e., does not show reactivity of more than 30%, preferably not more than 20%, more preferably not more than 10%, particularly preferably not more than 9%, 8%, 7%, 6% or 5% with proteins or antigens other than CDH19, whereby binding to CDH19, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

Proteins (including fragments thereof, preferably biologically active fragments, and peptides, usually having less than 30 amino acids) comprise one or more amino acids coupled to each other via a covalent peptide bond (resulting in a chain of amino acids). The term "polypeptide" as used herein describes a group of molecules, which consist of more than 30 amino acids. Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "polypeptide" and "protein" also refer to naturally modified polypeptides/proteins wherein the modification is effected e.g. by post-translational modifications like glycosylation, acetylation, phosphorylation and the like. A "polypeptide" when referred to herein may also be chemically modified such as pegylated. Such modifications are well known in the art.

"Isolated" when used to describe the antibody or antigen binding fragment thereof or antibody construct disclosed herein, refers to the antibody or antigen binding fragment thereof or antibody construct disclosed herein that has been identified, separated and/or recovered from a component of its production environment. Preferably, the isolated the antibody or antigen binding fragment thereof or antibody construct disclosed herein is free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. In preferred embodiments, the antibody or antigen binding fragment thereof or antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody will be prepared by at least one purification step.

Amino acid sequence modifications of the antibody or antigen binding fragment thereof or antibody construct described herein are contemplated. For example, it may be desirable to improve the binding affinity and/or other biological properties of the antibody. Amino acid sequence variants of the antibody or antigen binding fragment thereof or antibody construct disclosed herein are prepared by introducing appropriate nucleotide changes into the antibody or antigen binding fragment thereof or antibody construct nucleic acid, or by peptide synthesis.

Such modifications include, for example, deletions from, and/or insertions into, and/or substitutions of, residues within the amino acid sequences of the antibody or antigen binding fragment thereof or antibody construct disclosed herein. Any combination of deletion, insertion, and substitution is made to arrive at the final construct, provided that the final construct possesses the desired characteristics. The amino acid changes also may alter post-translational processes of the antibody or antigen binding fragment thereof or antibody construct disclosed herein, such as changing the number or position of glycosylation sites. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs). The substitutions are preferably conservative substitutions as described herein. Additionally or alternatively, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs.

A useful method for identification of certain residues or regions of the antibody or antigen binding fragment thereof or antibody construct disclosed herein that are preferred locations for mutagenesis is called "alanine scanning mutagenesis" as described by Cunningham and Wells in Science, 244: 1081-1085 (1989). Here, a residue or group of target residues within the antibody or antigen binding fragment thereof or antibody construct disclosed herein is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions then are refined by introducing further or other variants at, or for, the sites of substitution. Thus, while the site for introducing an amino acid sequence variation is predetermined, the nature of the mutation per se needs not to be predetermined. For example, to analyze the performance of a mutation at a given site, ala scanning or random mutagenesis is conducted at a target codon or region and the expressed the antibody or antigen binding fragment thereof or antibody construct disclosed herein variants are screened for the desired activity.

Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intrasequence insertions of single or multiple amino acid residues. An insertional variant of the antibody or antigen binding fragment thereof or antibody construct disclosed herein includes the fusion to the N- or C-terminus of the antibody to an enzyme or a fusion to a polypeptide which increases the serum half-life of the antibody.

Another type of variant is an amino acid substitution variant. These variants have preferably at least 1, 2, 3, 4, 5, 6, 7, 8, 9 or 10 amino acid residues in the antibody or antigen binding fragment thereof or antibody construct disclosed herein replaced by a different residue. The sites of greatest interest for substitutional mutagenesis include the CDRs of the heavy and/or light chain, in particular the hypervariable regions, but FR alterations in the heavy and/or light chain are also contemplated.

For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

Generally, if amino acids are substituted in one or more or all of the CDRs of the heavy and/or light chain, it is preferred that the n-obtained "substituted" sequence is at least 60%, more preferably 65%, even more preferably 70%, particularly preferably 75%, more particularly preferably 80% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody or antigen binding fragment thereof or antibody construct disclosed herein may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the antibody or antigen binding fragment thereof or antibody construct retains its capability to bind to CDH19 v and/or its CDRs have an identity to the n substituted sequence (at least 60%, more preferably 65%, even more preferably 70%, particularly preferably 75%, more particularly preferably 80% identical to the "original" CDR sequence).

Conservative substitutions are shown in Table 1 under the heading of "preferred substitutions". If such substitutions result in a change in biological activity, then more substantial changes, denominated "exemplary substitutions" in Table 1, or as further described below in reference to amino acid classes, may be introduced and the products screened for a desired characteristic.

TABLE 1

Amino Acid Substitutions

| Original | Exemplary Substitutions | Preferred Substitutions |
| --- | --- | --- |
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | Asp |
| Gly (G) | ala | Ala |
| His (H) | asn, gln, lys, arg | Arg |
| Ile (I) | leu, val, met, ala, phe | Leu |
| Leu (L) | norleucine, ile, val, met, ala | Ile |
| Lys (K) | arg, gln, asn | Arg |
| Met (M) | leu, phe, ile | Leu |
| Phe (F) | leu, val, ile, ala, tyr | Tyr |
| Pro (P) | ala | Ala |
| Ser (S) | thr | Thr |
| Thr (T) | ser | Ser |
| Trp (W) | tyr, phe | Tyr |
| Tyr (Y) | trp, phe, thr, ser | Phe |
| Val (V) | ile, leu, met, phe, ala | Leu |

Substantial modifications in the biological properties of the antibody or antigen binding fragment thereof or antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gln, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody or antigen binding fragment thereof or antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

A particularly preferred type of substitutional variant involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human CDH19. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

Other modifications of the antibody or antigen binding fragment thereof or antibody construct are contemplated herein. For example, the antibody or antigen binding fragment thereof or antibody construct may be linked to one of a variety of non-proteinaceous polymers, e.g., polyethylene glycol, polypropylene glycol, polyoxyalkylenes, or copolymers of polyethylene glycol and polypropylene glycol. The antibody or antigen binding fragment thereof or antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

The antibody or antigen binding fragment thereof or antibody construct disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731 published Oct. 23, 1997. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

When using recombinant techniques, the antibody, antigen binding fragment thereof or antibody construct can be produced intracellularly, in the periplasmic space, or directly secreted into the medium. If the antibody, antigen binding fragment thereof or antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of E. coli.

The antibody, antigen binding fragment thereof or antibody construct composition prepared from the cells can be purified using, for example, hydroxylapatite chromatography, gel electrophoresis, dialysis, and affinity chromatography, with affinity chromatography being the preferred purification technique.

The term "agent" is used herein to denote a chemical compound, a mixture of chemical compounds, a biological macromolecule, or an extract made from biological materials.

The term "nucleic acid" is well known to the skilled person and encompasses DNA (such as cDNA) and RNA (such as mRNA). The nucleic acid can be double stranded and single stranded, linear and circular. Said nucleic acid molecule is preferably comprised in a vector which is preferably comprised in a host cell. Said host cell is, e.g. after transformation or transfection with the nucleic acid sequence of the invention, capable of expressing the antibody or antigen binding fragment thereof or antibody construct disclosed herein. For that purpose the nucleic acid molecule is operatively linked with control sequences.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences such as a promoter sequence that drives expression of the transgene. Insertion of a vector into the target cell is usually called "transformation" for bacteria, "transfection" for eukaryotic cells, although insertion of a viral vector is also called "transduction".

As used herein, the term "host cell" is intended to refer to a cell into which a nucleic acid encoding the antibody or antigen binding fragment thereof or antibody construct of the invention is introduced by way of transformation, transfection and the like. It should be understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

As used herein, the term "expression" includes any step involved in the production of a the antibody or antigen binding fragment thereof or antibody construct of the invention including, but not limited to, transcription, post-transcriptional modification, translation, post-translational modification, and secretion.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The terms "host cell," "target cell" or "recipient cell" are intended to include any individual cell or cell culture that can be or has/have been recipients for vectors or the incorporation of exogenous nucleic acid molecules, polynucleotides and/or proteins. It also is intended to include progeny of a single cell, and the progeny may not necessarily be completely identical (in morphology or in genomic or total DNA complement) to the original parent cell due to natural, accidental, or deliberate mutation. The cells may be prokaryotic or eukaryotic, and include but are not limited to bacteria, yeast cells, animal cells, and mammalian cells, e.g., murine, rat, macaque or human.

Suitable host cells include prokaryotes and eukaryotic host cells including yeasts, fungi, insect cells and mammalian cells.

The antibody or antigen binding fragment thereof or antibody construct of the invention can be produced in bacteria. After expression, the antibody or antigen binding fragment thereof or antibody construct of the invention, preferably the antibody or antigen binding fragment thereof or antibody construct is isolated from the *E. coli* cell paste in a soluble fraction and can be purified through, e.g., affinity chromatography and/or size exclusion. Final purification can be carried out similar to the process for purifying antibody expressed e. g, in CHO cells.

In addition to prokaryotes, eukaryotic microbes such as filamentous fungi or yeast are suitable cloning or expression hosts for the antibody or antigen binding fragment thereof or antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as, e.g., *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as, e.g., *Neurospora, Penicillium, Tolypocladium*, and *Aspergillus* hosts such as *A. nidulans* and *A. niger*.

Suitable host cells for the expression of glycosylated the antibody or antigen binding fragment thereof or antibody construct of the invention, preferably antibody derived antibody constructs are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e. g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia*, tomato, *Arabidopsis* and tobacco can also be utilized as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, 1413 8065); mouse mammary tumor (MMT 060562, ATCC CCL5 1); TRI cells (Mather et al., Annals N. Y Acad. Sci. 383: 44-68 (1982)); MRC 5 cells; FS4 cells; and a human hepatoma line (Hep G2).

When using recombinant techniques, the antibody or antigen binding fragment thereof or antibody construct of the invention can be produced intracellularly, in the periplasmic space, or directly secreted into the medium. If the antibody or antigen binding fragment thereof or antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody or antigen binding fragment thereof or antibody construct of the invention prepared from the host cells can be purified using, for example, hydroxylapatite chromatography, gel electrophoresis, dialysis, and affinity chromatography, with affinity chromatography being the preferred purification technique.

The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose. Where the antibody or antigen binding fragment thereof or antibody construct of the invention comprises a CH3 domain, the Bakerbond ABXMresin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromato-focusing, SDS-PAGE, and ammonium sulfate precipitation are also available depending on the antibody to be recovered.

The term "culturing" refers to the in vitro maintenance, differentiation, growth, proliferation and/or propagation of cells under suitable conditions in a medium.

As used herein, the term "pharmaceutical composition" relates to a composition for administration to a patient, preferably a human patient. The particular preferred pharmaceutical composition of this invention comprises the antibody or antigen binding fragment thereof or antibody construct of the invention. Preferably, the pharmaceutical composition comprises suitable formulations of carriers, stabilizers and/or excipients. In a preferred embodiment, the pharmaceutical composition comprises a composition for parenteral, transdermal, intraluminal, intraarterial, intrathecal and/or intranasal administration or by direct injection into tissue. It is in particular envisaged that said composition is administered to a patient via infusion or injection. Administration of the suitable compositions may be effected by different ways, e.g., by intravenous, intraperitoneal, subcutaneous, intramuscular, topical or intradermal administration. In particular, the present invention provides for an uninterrupted administration of the suitable composition. As a non-limiting example, uninterrupted, i.e. continuous administration may be realized by a small pump system worn by the patient for metering the influx of therapeutic agent into the body of the patient. The pharmaceutical composition comprising the antibody or antigen binding fragment thereof or antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of these antibody or antigen binding fragment thereof or antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

The inventive compositions may further comprise a pharmaceutically acceptable carrier. Examples of suitable pharmaceutical carriers are well known in the art and include solutions, e.g. phosphate buffered saline solutions, water, emulsions, such as oil/water emulsions, various types of wetting agents, sterile solutions, liposomes, etc. Compositions comprising such carriers can be formulated by well known conventional methods. Formulations can comprise carbohydrates, buffer solutions, amino acids and/or surfactants. Carbohydrates may be non-reducing sugars, preferably trehalose, sucrose, octasulfate, sorbitol or xylitol. In general, as used herein, "pharmaceutically acceptable carrier" means any and all solvents, dispersion media, coatings, antibacterial and antifungal agents, isotonic and absorption delaying agents, compatible with pharmaceutical administration. The use of such media and agents for pharmaceutically active substances is well known in the art. Acceptable carriers, excipients, or stabilizers are nontoxic to recipients at the dosages and concentrations employed and include: additional buffering agents; preservatives; co-solvents; antioxidants, including ascorbic acid and methionine; chelating agents such as EDTA; metal complexes (e.g., Zn-protein complexes); biodegradable polymers, such as polyesters; salt-forming counter-ions, such as sodium, polyhydric sugar alcohols; amino acids, such as alanine, glycine, asparagine, 2-phenylalanine, and threonine; sugars or sugar alcohols, such as trehalose, sucrose, octasulfate, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; sulfur containing reducing agents, such as glutathione, thioctic acid, sodium thioglycolate, thioglycerol, [alpha]-monothioglycerol, and sodium thio sulfate; low molecular weight proteins, such as human serum albumin, bovine serum albumin, gelatin, or other immunoglobulins; and hydrophilic polymers, such as polyvinylpyrrolidone. Such formulations may be used for continuous administrations which may be intravenous or subcutaneous with and/or without pump systems. Amino acids may be charged amino acids, preferably lysine, lysine acetate, arginine, glutamate and/or histidine. Surfactants may be detergents, preferably with a molecular weight of >1.2 KD and/or a polyether, preferably with a molecular weight of >3 KD. Non-limiting examples for preferred detergents are Tween 20, Tween 40, Tween 60, Tween 80 or Tween 85. Non-limiting examples for preferred polyethers are PEG 3000, PEG 3350, PEG 4000 or PEG 5000. Buffer systems used in the present invention can have a preferred pH of 5-9 and may comprise citrate, succinate, phosphate, histidine and acetate.

The compositions of the present invention can be administered to the subject at a suitable dose which can be determined e.g. by dose escalating studies by administration of increasing doses of the polypeptide of the invention exhibiting cross-species specificity described herein to non-chimpanzee primates, for instance macaques. As set forth above, the antibody or antigen binding fragment thereof or antibody construct of the invention exhibiting cross-species specificity described herein can be advantageously used in identical form in preclinical testing in non-chimpanzee primates and as drug in humans. These compositions can also be administered in combination with other proteinaceous and non-proteinaceous drugs. These drugs may be administered simultaneously with the composition comprising the polypeptide of the invention as defined herein or separately before or after administration of said polypeptide in timely defined intervals and doses. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, inert gases and the like. In addition, the composition of the present invention might comprise proteinaceous carriers, like, e.g., serum albumin or immunoglobulin, preferably of human origin. It is envisaged that the composition of the invention might comprise, in addition to the polypeptide of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody or antigen binding fragment thereof or antibody construct of the present invention is applied in a co-therapy, i.e., in combination with another anti-cancer medicament.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the rapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc.

By "hepatic first-pass metabolism" is meant the propensity of a drug to be metabolized upon first contact with the liver, i.e. during its first pass through the liver.

"Volume of distribution" means the degree of retention of a drug throughout the various compartments of the body, like e.g. intracellular and extracellular spaces, tissues and organs, etc. and the distribution of the drug within these compartments.

"Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma.

"Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific single chain antibodies exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts effective for this use will depend upon the severity of the infection and the general state of the subject's own immune system. The term "patient" includes human and other mammalian subjects that receive either prophylactic or therapeutic treatment.

The term "effective and non-toxic dose" as used herein refers to a tolerable dose of an inventive antibody or antigen binding fragment thereof or antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

The appropriate dosage, or therapeutically effective amount, of the antibody or antigen binding fragment thereof or antibody construct of the invention will depend on the condition to be treated, the severity of the condition, prior therapy, and the patient's clinical history and response to the therapeutic agent. The proper dose can be adjusted according to the judgment of the attending physician such that it can be administered to the patient one time or over a series of administrations. The pharmaceutical composition can be administered as a sole therapeutic or in combination with additional therapies such as anti-cancer therapies as needed.

The pharmaceutical compositions of this invention are particularly useful for parenteral administration, i.e., subcutaneously, intramuscularly, intravenously, intra-articular and/or intra-synovial. Parenteral administration can be by bolus injection or continuous infusion.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

In an internal analysis of proprietary mRNA expression data it has been surprisingly found that CDH19 expression is elevated in both primary and metastatic melanoma tumors compared to normal, untransformed tissues. Internal analysis also confirmed that expression of CDH19 in normal tissues is limited to neural crest derived peripheral nerve ganglia and nerve fibers. The differential CDH19 expression in normal and tumor tissues makes this protein attractive for cell-surface targeting therapeutics. Although CDH 19 was discussed as one marker as part of long lists of markers associated with some cancer types (see e.g. WO2009/055937) or Parkinson's disease (see e.g. WO2005/067391) CDH19 was never discussed as a prognostic marker or a drug target in connection with melanoma tumors.

As stated above, the present invention provides an isolated human antibody or antigen binding fragment thereof capable of binding to human CDH19 on the surface of a target cell. In a preferred embodiment the antibody or antigen binding fragment thereof comprises a monoclonal antibody or a fragment thereof.

The "CDH19 extracellular domain" or "CDH19 ECD" refers to a form of CDH19 which is essentially free of transmembrane and cytoplasmic domains of CDH19. It will be understood by the skilled artisan that the transmembrane domain identified for the CDH19 polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein. A preferred human CDH19 ECD is shown in SEQ ID NO: 948 (aa residues 44-596). In this context it is understood that the CDH19 ECD represents the part of CDH19 on the surface of a target cell.

The affinity of the antibody or fragment thereof for human CDH19 is preferably ≤515 nM, more preferably ≤510 nM, even more preferably ≤55 nM, even more preferably ≤51 nM, even more preferably ≤50.5 nM, even more preferably ≤50.1 nM, and most preferably ≤50.05 nM. The affinity of the first binding domain for macaque CDH19 is preferably ≤515 nM, more preferably 10 nM, even more preferably ≤55 nM, even more preferably ≤51 nM, even more preferably 0.5 nM, even more preferably ≤50.1 nM, and most preferably ≤50.05 nM or even ≤50.01 nM. The affinity can be measured for example in a Biacore assay or in a Scatchard assay, e.g. as described in the Examples. The affinity gap for binding to macaque CDH19 versus human CDH19 is preferably [1:10-1:5] or [5:1-10:1], more preferably [1:5-5:1], and most preferably [1:2-3:1] or even [1:1-3:1]. Other methods of determining the affinity are well-known to the skilled person.

Human antibodies avoid some of the problems associated with antibodies that possess murine or rat variable and/or constant regions. The presence of such murine or rat derived proteins can lead to the rapid clearance of the antibodies or can lead to the generation of an immune response against the antibody by a patient. In order to avoid the utilization of murine or rat derived antibodies, human or fully human antibodies can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the utilization of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies are expected to minimize the immunogenic and allergic responses intrinsic to mouse or mouse-derivatized mAbs and thus to increase the efficacy and safety of the administered antibodies. The use of fully human antibodies can be expected to provide a substantial advantage in the treatment of chronic and recurring human diseases, such as inflammation, autoimmunity, and cancer, which require repeated antibody administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with our generation of the first Xeno-Mouse mouse strains, as published in 1994. (See Green et al. Nature Genetics 7:13-21 (1994)) The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. Id. The human Ig containing YACs proved to be compatible with the mouse system for both rearrangement and expression of antibodies and were capable of substituting for the inactivated mouse Ig genes. This was demonstrated by their ability to induce B-cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620, filed Dec. 3, 1996, the disclosures of which are hereby incorporated by reference.

The production of the XenoMouse mice is further discussed and delineated in U.S. patent application Ser. No. 07/466,008, filed Jan. 12, 1990, Ser. No. 07/610,515, filed Nov. 8, 1990, Ser. No. 07/919,297, filed Jul. 24, 1992, Ser. No. 07/922,649, filed Jul. 30, 1992, filed Ser. No. 08/031,801, filed Mar. 15, 1993, Ser. No. 08/112,848, filed Aug. 27, 1993, Ser. No. 08/234,145, filed Apr. 28, 1994, Ser. No. 08/376,279, filed Jan. 20, 1995, Ser. No. 08/430,938, Apr. 27, 1995, Ser. No. 08/464,584, filed Jun. 5, 1995, Ser. No. 08/464,582, filed Jun. 5, 1995, Ser. No. 08/463,191, filed Jun. 5, 1995, Ser. No. 08/462,837, filed Jun. 5, 1995, Ser. No. 08/486,853, filed Jun. 5, 1995, Ser. No. 08/486,857, filed Jun. 5, 1995, Ser. No. 08/486,859, filed Jun. 5, 1995, Ser. No. 08/462,513, filed Jun. 5, 1995, Ser. No. 08/724,752, filed Oct. 2, 1996, and Ser. No. 08/759,620, filed Dec. 3, 1996 and U.S. Pat. Nos. 6,162,963, 6,150,584, 6,114,598, 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998). See also European Patent No., EP 0 463151 B1, grant published Jun. 12, 1996, International Patent Application No., WO 94/02602, published Feb. 3, 1994, International Patent Application No., WO 96/34096, published Oct. 31, 1996, WO 98/24893, published Jun. 11, 1998, WO 00/76310, published Dec. 21, 2000, WO 03/47336. The disclosures of each of the above-cited patents, applications, and references are hereby incorporated by reference in their entirety.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more V.sub.H genes, one or more D.sub.H genes, one or more J.sub.H genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806, 5,625,825, 5,625,126, 5,633,425, 5,661,016, 5,770,429, 5,789,650, 5,814,318, 5,877,397, 5,874,299, and 6,255,458 each to Lonberg and Kay, U.S. Pat. Nos. 5,591,669 and 6,023,010 to Krimpenfort and Berns, U.S. Pat. Nos. 5,612,205, 5,721,367, and 5,789,215 to Berns et al., and U.S. Pat. No. 5,643,763 to Choi and Dunn, and GenPharm International U.S. patent application Ser. No. 07/574,748, filed Aug. 29, 1990, Ser. No. 07/575,962, filed Aug. 31, 1990, Ser.

No. 07/810,279, filed Dec. 17, 1991, Ser. No. 07/853,408, filed Mar. 18, 1992, Ser. No. 07/904,068, filed Jun. 23, 1992, Ser. No. 07/990,860, filed Dec. 16, 1992, Ser. No. 08/053,131, filed Apr. 26, 1993, Ser. No. 08/096,762, filed Jul. 22, 1993, Ser. No. 08/155,301, filed Nov. 18, 1993, Ser. No. 08/161,739, filed Dec. 3, 1993, Ser. No. 08/165,699, filed Dec. 10, 1993, Ser. No. 08/209,741, filed Mar. 9, 1994, the disclosures of which are hereby incorporated by reference. See also European Patent No. 0 546 073 B 1, International Patent Application Nos. WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175, the disclosures of which are hereby incorporated by reference in their entirety. See further Taylor et al., 1992, Chen et al., 1993, Tuaillon et al., 1993, Choi et al., 1993, Lonberg et al., (1994), Taylor et al., (1994), and Tuaillon et al., (1995), Fishwild et al., (1996), the disclosures of which are hereby incorporated by reference in their entirety.

Kirin has also demonstrated the generation of human antibodies from mice in which, through microcell fusion, large pieces of chromosomes, or entire chromosomes, have been introduced. See European Patent Application Nos. 773 288 and 843 961, the disclosures of which are hereby incorporated by reference. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996, 5,698,767, and 5,958,765.

Human anti-mouse antibody (HAMA) responses have led the industry to prepare chimeric or otherwise humanized antibodies. While chimeric antibodies have a human constant region and a murine variable region, it is expected that certain human anti-chimeric antibody (HACA) responses will be observed, particularly in chronic or multi-dose utilizations of the antibody. Thus, it would be desirable to provide fully human antibodies against EGFRvIII in order to vitiate concerns and/or effects of HAMA or HACA response.

According to one embodiment the antibody of the present invention is a dimer comprising two fusion proteins created by fusing a CDH19 binding fragment of a CDH19 antibody to the Fc region of an antibody. The dimer can be made by, for example, inserting a gene fusion encoding the fusion protein into an appropriate expression vector, expressing the gene fusion in host cells transformed with the recombinant expression vector, and allowing the expressed fusion protein to assemble much like antibody molecules, whereupon interchain disulfide bonds form between the Fc moieties to yield the dimer.

The term "Fc polypeptide" as used herein includes native and mutein forms of polypeptides derived from the Fc region of an antibody. Truncated forms of such polypeptides containing the hinge region that promotes dimerization also are included. Fusion proteins comprising Fc moieties (and oligomers formed therefrom) offer the advantage of *facile* purification by affinity chromatography over Protein A or Protein G columns.

One suitable Fc polypeptide, described in PCT application WO 93/10151 (hereby incorporated by reference), is a single chain polypeptide extending from the N-terminal hinge region to the native C-terminus of the Fc region of a human IgG antibody. Another useful Fc polypeptide is the Fc mutein described in U.S. Pat. No. 5,457,035 and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

Alternatively, the antibody of the invention is a fusion protein comprising multiple CDH19 antibody polypeptides, with or without peptide linkers (spacer peptides). Among the suitable peptide linkers are those described in U.S. Pat. Nos. 4,751,180 and 4,935,233 or WO 88/09344.

Another method for preparing oligomeric CDH19 antibody derivatives involves use of a leucine zipper. Leucine zipper domains are peptides that promote oligomerization of the proteins in which they are found. Leucine zippers were originally identified in several DNA-binding proteins (Landschulz et al., 1988, *Science* 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, *FEBS Letters* 344:191, hereby incorporated by reference. The use of a modified leucine zipper that allows for stable trimerization of a heterologous protein fused thereto is described in Fanslow et al., 1994, *Semin. Immunol.* 6:267-78. In one approach, recombinant fusion proteins comprising CDH19 antibody fragment or derivative fused to a leucine zipper peptide are expressed in suitable host cells, and the soluble oligomeric CDH19 antibody fragments or derivatives that form are recovered from the culture supernatant.

Covalent modifications of antigen binding proteins are included within the scope of this invention, and are generally, but not always, done post-translationally. For example, several types of covalent modifications of the antigen binding protein are introduced into the molecule by reacting specific amino acid residues of the antigen binding protein with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin.

Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}I$ or $^{131}I$ to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking antigen binding proteins to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antigen binding protein included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antigen binding protein is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antigen binding protein amino acid sequence is preferably altered through changes at the DNA level, particularly by mutating the DNA encoding the target polypeptide at preselected bases such that codons are generated that will translate into the desired amino acids.

Another means of increasing the number of carbohydrate moieties on the antigen binding protein is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 published Sep. 11, 1987, and in Aplin and Wriston, 1981, *CRC Crit. Rev. Biochem., pp.* 259-306.

Removal of carbohydrate moieties present on the starting antigen binding protein may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, *Arch. Biochem. Biophys.* 259:52 and by Edge et al., 1981, *Anal. Biochem.* 118:131. Enzymatic cleavage of carbohydrate moieties on polypeptides can be achieved by the use of a variety of endo- and exo-glycosidases as described by Thotakura et al., 1987, *Meth. Enzymol.* 138:350. Glycosylation at potential glycosylation sites may be prevented by the use of the compound tunicamycin as described by Duskin et al., 1982, *J. Biol. Chem.* 257:3105. Tunicamycin blocks the formation of protein-N-glycoside linkages.

Another type of covalent modification of the antigen binding protein comprises linking the antigen binding protein to various non-proteinaceous polymers, including, but not limited to, various polyols such as polyethylene glycol, polypropylene glycol or polyoxyalkylenes, in the manner set forth in U.S. Pat. No. 4,640,835; 4,496,689; 4,301,144; 4,670,417; 4,791,192 or 4,179,337. In addition, as is known in the art, amino acid substitutions may be made in various positions within the antigen binding protein to facilitate the addition of polymers such as PEG.

In some embodiments, the covalent modification of the antigen binding proteins of the invention comprises the addition of one or more labels.

The term "labelling group" means any detectable label. Examples of suitable labelling groups include, but are not limited to, the following: radioisotopes or radionuclides (e.g., $^{3}$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labelling group is coupled to the antigen binding protein via spacer arms of various lengths to reduce potential steric hindrance. Various methods for labelling proteins are known in the art and may be used in performing the present invention.

In general, labels fall into a variety of classes, depending on the assay in which they are to be detected: a) isotopic labels, which may be radioactive or heavy isotopes; b) magnetic labels (e.g., magnetic particles); c) redox active moieties; d) optical dyes; enzymatic groups (e.g. horseradish peroxidase, β-galactosidase, luciferase, alkaline phosphatase); e) biotinylated groups; and f) predetermined polypeptide epitopes recognized by a secondary reporter (e.g., leucine zipper pair sequences, binding sites for secondary antibodies, metal binding domains, epitope tags, etc.). In some embodiments, the labelling group is coupled to the antigen binding protein via spacer arms of various lengths to reduce potential steric hindrance. Various methods for labelling proteins are known in the art and may be used in performing the present invention.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland, hereby expressly incorporated by reference.

Suitable proteinaceous fluorescent labels also include, but are not limited to, green fluorescent protein, including a Renilla, Ptilosarcus, or Aequorea species of GFP (Chalfie et al., 1994, *Science* 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, *Biotechniques* 24:462-471; Heim et al., 1996, *Curr. Biol.* 6:178-182), enhanced yellow fluorescent protein (EYFP, Clontech Laboratories, Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and Renilla (WO92/15673, WO95/07463, WO98/14605, WO98/26277, WO99/49019, U.S. Pat. Nos. 5,292,658, 5,418,155, 5,683,888, 5,741,668, 5,777,079, 5,804,387, 5,874,304, 5,876,995, 5,925,558). All of the above-cited references are expressly incorporated herein by reference.

As described in appended example 2 a broad number of CDH19 specific binder has been characterized with respect to identified binding characteristics and those binders were grouped into five different bins, which refers to five different subgroups of CDH19 specific binding domains. Accordingly, in one embodiment the human antibody or antigen binding fragment thereof of the invention comprises a human binding domain or antigen binding fragment thereof comprising a VH region comprising CDR-H1, CDR-H2 and CDR-H3 and a VL region comprising CDR-L1, CDR-L2 and CDR-L3 selected from the group consisting of:

(a) CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 222, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 252, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 82, CDR-H2 as depicted in SEQ ID NO: 83, CDR-H3 as depicted in SEQ ID NO: 909, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 926, and CDR-H1 as depicted in SEQ ID NO: 52, CDR-H2 as depicted in SEQ ID NO: 53, CDR-H3 as depicted in SEQ ID NO: 904, CDR-L1 as depicted in SEQ ID NO: 220, CDR-L2 as depicted in SEQ ID NO: 221 and CDR-L3 as depicted in SEQ ID NO: 926; which all characterize binding domains for CDH19 grouped into bin 1;

(b) CDR-H1 as depicted in SEQ ID NO: 124, CDR-H2 as depicted in SEQ ID NO: 125, CDR-H3 as depicted in SEQ ID NO: 126, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 300, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 306, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 312, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO:

166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 928, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 929, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 942, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 943, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 937, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 148, CDR-H2 as depicted in SEQ ID NO: 149, CDR-H3 as depicted in SEQ ID NO: 919, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 936, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 933, CDR-H1 as depicted in SEQ ID NO: 136, CDR-H2 as depicted in SEQ ID NO: 137, CDR-H3 as depicted in SEQ ID NO: 917, CDR-L1 as depicted in SEQ ID NO: 304, CDR-L2 as depicted in SEQ ID NO: 305 and CDR-L3 as depicted in SEQ ID NO: 934, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 930, CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 931, and CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 932; which all characterize binding domains for CDH19 grouped into bin 2;

(c) CDR-H1 as depicted in SEQ ID NO: 94, CDR-H2 as depicted in SEQ ID NO: 95, CDR-H3 as depicted in SEQ ID NO: 96, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 100, CDR-H2 as depicted in SEQ ID NO: 101, CDR-H3 as depicted in SEQ ID NO: 102, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 154, CDR-H2 as depicted in SEQ ID NO: 155, CDR-H3 as depicted in SEQ ID NO: 156, CDR-L1 as depicted in SEQ ID NO: 322, CDR-L2 as depicted in SEQ ID NO: 323 and CDR-L3 as depicted in SEQ ID NO: 324, CDR-H1 as depicted in SEQ ID NO: 100, CDR-H2 as depicted in SEQ ID NO: 101, CDR-H3 as depicted in SEQ ID NO: 912, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 100, CDR-H2 as depicted in SEQ ID NO: 101, CDR-H3 as depicted in SEQ ID NO: 913, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 94, CDR-H2 as depicted in SEQ ID NO: 95, CDR-H3 as depicted in SEQ ID NO: 910, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 94, CDR-H2 as depicted in SEQ ID NO: 95, CDR-H3 as depicted in SEQ ID NO: 911, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 118, CDR-H2 as depicted in SEQ ID NO: 914, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, and CDR-H1 as depicted in SEQ ID NO: 154, CDR-H2 as depicted in SEQ ID NO: 155, CDR-H3 as depicted in SEQ ID NO: 920, CDR-L1 as depicted in SEQ ID NO: 322, CDR-L2 as depicted in SEQ ID NO: 323 and CDR-L3 as depicted in SEQ ID NO: 324;

which all characterize binding domains for CDH19 grouped into bin 3;

(d) CDR-H1 as depicted in SEQ ID NO: 4, CDR-H2 as depicted in SEQ ID NO: 5, CDR-H3 as depicted in SEQ ID NO: 6, CDR-L1 as depicted in SEQ ID NO: 172, CDR-L2 as depicted in SEQ ID NO: 173 and CDR-L3 as depicted in SEQ ID NO: 174, CDR-H1 as depicted in SEQ ID NO: 10, CDR-H2 as depicted in SEQ ID NO: 11, CDR-H3 as depicted in SEQ ID NO: 12, CDR-L1 as depicted in SEQ ID NO: 178, CDR-L2 as depicted in SEQ ID NO: 179 and CDR-L3 as depicted in SEQ ID NO: 180, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 198, CDR-H1 as depicted in SEQ ID NO: 34, CDR-H2 as depicted in SEQ ID NO: 35, CDR-H3 as depicted in SEQ ID NO: 36, CDR-L1 as depicted in SEQ ID NO: 202, CDR-L2 as depicted in SEQ ID NO: 203 and CDR-L3 as depicted in SEQ ID NO: 204, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 214, CDR-L2 as depicted in SEQ ID NO: 215 and CDR-L3 as depicted in SEQ ID NO: 216, CDR-H1 as depicted in SEQ ID NO: 58, CDR-H2 as depicted in SEQ ID NO: 59, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 64, CDR-H2 as depicted in SEQ ID NO: 65, CDR-H3 as depicted in SEQ ID NO: 66, CDR-L1 as depicted in SEQ ID NO: 232, CDR-L2 as depicted in SEQ ID NO: 233 and CDR-L3 as depicted in SEQ ID NO: 234, CDR-H1 as depicted in SEQ ID NO: 70, CDR-H2 as depicted in SEQ ID NO: 71, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 328, CDR-L2 as depicted in SEQ ID NO: 329 and CDR-L3 as depicted in SEQ ID NO: 330, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 902, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 903, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 925, CDR-L2 as depicted in SEQ ID NO: 215 and CDR-L3 as depicted in SEQ ID NO: 216, CDR-H1 as depicted in SEQ ID NO: 70, CDR-H2 as depicted in SEQ ID NO: 907, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 70, CDR-H2 as depicted in SEQ ID NO: 907, CDR-H3 as depicted in SEQ ID NO: 908, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 58, CDR-H2 as depicted in SEQ ID NO: 905, CDR-H3 as depicted in SEQ ID NO: 906, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 58, CDR-H2 as depicted in SEQ ID NO: 905, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 330, CDR-H1 as depicted in SEQ ID NO: 160, CDR-H2 as depicted in SEQ ID NO: 921, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 940, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 941, CDR-L2 as depicted in SEQ ID NO: 329 and CDR-L3 as depicted in SEQ ID NO: 330, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, and CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 939, CDR-L2 as depicted in SEQ ID NO: 329 and CDR-L3 as depicted in SEQ ID NO: 330;

which all characterize binding domains for CDH19 grouped into bin 4; and (e) CDR-H1 as depicted in SEQ ID NO: 76, CDR-H2 as depicted in SEQ ID NO: 77, CDR-H3 as depicted in SEQ ID NO: 78, CDR-L1 as depicted in SEQ ID NO: 244, CDR-L2 as depicted in SEQ ID NO: 245 and CDR-L3 as depicted in SEQ ID NO: 246, CDR-H1 as depicted in SEQ ID NO: 88, CDR-H2 as depicted in SEQ ID NO: 89, CDR-H3 as depicted in SEQ ID NO: 90, CDR-L1 as depicted in SEQ ID NO: 256, CDR-L2 as depicted in SEQ ID NO: 257 and CDR-L3 as depicted in SEQ ID NO: 258, CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276, CDR-H1 as depicted in SEQ ID NO: 112, CDR-H2 as depicted in SEQ ID NO: 113, CDR-H3 as depicted in SEQ ID NO: 114, CDR-L1 as depicted in SEQ ID NO: 280, CDR-L2 as depicted in SEQ ID NO: 281 and CDR-L3 as depicted in SEQ ID NO: 282, and CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276 which all characterize binding domains for CDH19 grouped into bin 5;

In a further embodiment of the human antibody or antigen binding fragment thereof of the invention the human binding domain or antigen binding fragment thereof comprises a VH region selected from the group consisting of VH regions (a) as depicted in SEQ ID NO: 362, SEQ ID NO: 364, SEQ ID NO: 485, SEQ ID NO: 486, SEQ ID NO: 487, SEQ ID NO: 492, SEQ ID NO: 493, SEQ ID NO: 494, and SEQ ID NO: 495;

which all characterize binding domains for CDH19 grouped into bin 1;

(b) as depicted in SEQ ID NO: 342, SEQ ID NO: 366, SEQ ID NO: 370, SEQ ID NO: 344, SEQ ID NO: 372, SEQ ID NO: 368, SEQ ID NO: 496, SEQ ID NO: 497, SEQ ID NO: 498, SEQ ID NO: 499, SEQ ID NO: 500, SEQ ID NO: 508, SEQ ID NO: 509, SEQ ID NO: 510, SEQ ID NO: 511, SEQ ID NO: 512, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, and SEQ ID NO: 538;

which all characterize binding domains for CDH19 grouped into bin 2;

(c) as depicted in SEQ ID NO: 338, SEQ ID NO: 354, SEQ ID NO: 378, SEQ ID NO: 356, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 501, SEQ ID NO: 502, SEQ ID NO: 503, SEQ ID NO: 504, SEQ ID NO: 505, SEQ ID NO: 506, SEQ ID NO: 517, and SEQ ID NO: 518;

which all characterize binding domains for CDH19 grouped into bin 3;

(d) as depicted in SEQ ID NO: 352, SEQ ID NO: 360, SEQ ID NO: 388, SEQ ID NO: 386, SEQ ID NO: 340, SEQ ID NO: 346, SEQ ID NO: 374, SEQ ID NO: 348, SEQ ID NO: 390, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 488, SEQ ID NO: 489, SEQ ID NO: 490, SEQ ID NO: 491, SEQ ID NO: 513, SEQ ID NO: 514, SEQ ID NO: 515, SEQ ID NO: 516, SEQ ID NO: 540, SEQ ID NO: 541, SEQ ID NO: 542, and SEQ ID NO: 543;

which all characterize binding domains for CDH19 grouped into bin 4; and (e) as depicted in SEQ ID NO: 376, SEQ ID NO: 392, SEQ ID NO: 358, SEQ ID NO: 350, and SEQ ID NO: 507;

which all characterize binding domains for CDH19 grouped into bin 5.

In another embodiment the human antibody or antigen binding fragment thereof of the invention comprises the human binding domain or antigen binding fragment thereof comprising a VL region selected from the group consisting of VL regions (a) as depicted in SEQ ID NO: 418, SEQ ID NO: 420, SEQ ID NO: 580, SEQ ID NO: 581, SEQ ID NO: 582, SEQ ID NO: 587, SEQ ID NO: 588, SEQ ID NO: 589, and SEQ ID NO: 590;

which all characterize binding domains for CDH19 grouped into bin 1;

(b) as depicted in SEQ ID NO: 398, SEQ ID NO: 422, SEQ ID NO: 426, SEQ ID NO: 400, SEQ ID NO: 428, SEQ ID NO: 424, SEQ ID NO: 591, SEQ ID NO: 592, SEQ ID NO: 593, SEQ ID NO: 594, SEQ ID NO: 595, SEQ ID NO: 603, SEQ ID NO: 604, SEQ ID NO: 605, SEQ ID NO: 606, SEQ ID NO: 607, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, and SEQ ID NO: 633;

which all characterize binding domains for CDH19 grouped into bin 2;

(c) as depicted in SEQ ID NO: 394, SEQ ID NO: 410, SEQ ID NO: 434, SEQ ID NO: 412, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 596, SEQ ID NO: 597, SEQ ID NO: 598, SEQ ID NO: 599, SEQ ID NO: 600, SEQ ID NO: 601, SEQ ID NO: 612, and SEQ ID NO: 613;

which all characterize binding domains for CDH19 grouped into bin 3;

(d) as depicted in SEQ ID NO: 408, SEQ ID NO: 416, SEQ ID NO: 444, SEQ ID NO: 442, SEQ ID NO: 396, SEQ ID NO: 402, SEQ ID NO: 430, SEQ ID NO: 404, SEQ ID NO: 446, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 583, SEQ ID NO: 584, SEQ ID NO: 585, SEQ ID NO: 586, SEQ ID NO: 608, SEQ ID NO: 609, SEQ ID NO: 610, SEQ ID NO: 611, SEQ ID NO: 635, SEQ ID NO: 636, SEQ ID NO: 637, and SEQ ID NO: 638;

which all characterize binding domains for CDH19 grouped into bin 4; and (e) as depicted in SEQ ID NO: 432, SEQ ID NO: 448, SEQ ID NO: 414, SEQ ID NO: 406, and SEQ ID NO: 602;

which all characterize binding domains for CDH19 grouped into bin 5.

The invention further provides an embodiment of the human antibody or antigen binding fragment thereof of the invention, wherein the human binding domain or antigen binding fragment thereof comprises a VH region and a VL region selected from the group consisting of:

(1) pairs of a VH region and a VL region as depicted in SEQ ID NOs: 362+418, SEQ ID NOs: 364+420, SEQ ID NOs: 485+580, SEQ ID NOs: 486+581, SEQ ID NOs: 487+582, SEQ ID NOs: 492+587, SEQ ID NOs: 493+588, SEQ ID NOs: 494+589, and SEQ ID NOs: 495+590; all pairs grouped into bin 1;

(2) pairs of a VH region and a VL region as depicted in SEQ ID NOs: 342+398, SEQ ID NOs: 366+422, SEQ ID NOs: 370+426, SEQ ID NOs: 344+400, SEQ ID NOs: 372+428, SEQ ID NOs: 368+424, SEQ ID NOs: 496+591, SEQ ID NOs: 497+592, SEQ ID NOs: 498+593, SEQ ID NOs: 499+594, SEQ ID NOs: 500+595, SEQ ID NOs: 508+603, SEQ ID NOs: 509+604, SEQ ID NOs: 510+605, SEQ ID NOs: 511+606, SEQ ID NOs: 512+607, SEQ ID NOs: 519+614, SEQ ID NOs: 520+615, SEQ ID NOs: 521+616, SEQ ID NOs: 522+617, SEQ ID NOs: 523+618, SEQ ID NOs: 524+619, SEQ ID NOs: 525+620, SEQ ID NOs: 526+621, SEQ ID NOs: 527+622, SEQ ID NOs: 528+623, SEQ ID NOs: 529+624, SEQ ID NOs: 530+625, SEQ ID NOs: 531+626, SEQ ID NOs: 532+627, SEQ ID NOs: 533+628, SEQ ID NOs: 534+629, SEQ ID NOs: 535+630, SEQ ID NOs: 536+631, SEQ ID NOs: 537+632, and SEQ ID NOs: 538+633; all pairs grouped into bin 2;

(3) pairs of a VH region and a VL region as depicted in SEQ ID NOs: 338+394, SEQ ID NOs: 354+410, SEQ ID NOs: 378+434, SEQ ID NOs: 356+412, SEQ ID NOs: 476+571, SEQ ID NOs: 477+572, SEQ ID NOs: 478+573, SEQ ID NOs: 479+574, SEQ ID NOs: 480+575, SEQ ID NOs: 481+576, SEQ ID NOs: 482+577, SEQ ID NOs: 483+578, SEQ ID NOs: 484+579, SEQ ID NOs: 501+596, SEQ ID NOs: 502+597, SEQ ID NOs: 503+598, SEQ ID NOs: 504+599, SEQ ID NOs: 505+600, SEQ ID NOs: 506+601, SEQ ID NOs: 517+612, and SEQ ID NOs: 518+613; all pairs grouped into bin 3;

(4) pairs of a VH region and a VL region as depicted in SEQ ID NOs: 352+408, SEQ ID NOs: 360+416, SEQ ID NOs: 388+444, SEQ ID NOs: 386+442, SEQ ID NOs: 340+396, SEQ ID NOs: 346+402, SEQ ID NOs: 374+430, SEQ ID NOs: 348+404, SEQ ID NOs: 390+446, SEQ ID NOs: 463+558, SEQ ID NOs: 464+559, SEQ ID NOs: 465+560, SEQ ID NOs: 466+561, SEQ ID NOs: 467+562, SEQ ID NOs: 468+563, SEQ ID NOs: 469+564, SEQ ID NOs: 470+565, SEQ ID NOs: 471+566, SEQ ID NOs: 472+567, SEQ ID NOs: 473+568, SEQ ID NOs: 474+569, SEQ ID NOs: 475+570, SEQ ID NOs: 488+583, SEQ ID NOs: 489+584, SEQ ID NOs: 490+585, SEQ ID NOs: 491+586, SEQ ID NOs: 513+608, SEQ ID NOs: 514+609, SEQ ID NOs: 515+610, SEQ ID NOs: 516+611, SEQ ID NOs: 540+635, SEQ ID NOs: 541+636, SEQ ID NOs: 542+637, and SEQ ID NOs: 543+638; all pairs grouped into bin 4; and (5) pairs of a VH region and a VL region as depicted in SEQ ID NOs: 376+432, SEQ ID NOs: 392+448, SEQ ID NOs: 358+414, SEQ ID NOs: 350+406, and SEQ ID NOs: 507+602; all pairs grouped into bin 5.

In a further embodiment the human binding domain or antigen binding fragment thereof comprises the groups of heavy and light chains having an amino acid sequence selected from the group consisting of (1) a heavy and light chain as depicted in SEQ ID NOs: 644+680, SEQ ID NOs: 650+686, SEQ ID NOs: 747+842, SEQ ID NOs: 748+843, SEQ ID NOs: 749+844, SEQ ID NOs: 754+849, SEQ ID NOs: 755+850, SEQ ID NOs: 756+851, and SEQ ID NOs: 757+852; all pairs grouped into bin 1;

(2) a heavy and light chain as depicted in SEQ ID NOs: 660+696, SEQ ID NOs: 662+698, SEQ ID NOs: 668+704, SEQ ID NOs: 674+710, SEQ ID NOs: 672+708, SEQ ID NOs: 658+694, SEQ ID NOs: 758+853, SEQ ID NOs: 759+854, SEQ ID NOs: 760+855, SEQ ID NOs: 761+856, SEQ ID NOs: 762+857, SEQ ID NOs: 770+865, SEQ ID NOs: 771+866, SEQ ID NOs: 772+867, SEQ ID NOs: 773+868, SEQ ID NOs: 774+869, SEQ ID NOs: 781+876, SEQ ID NOs: 782+877, SEQ ID NOs: 783+878, SEQ ID NOs: 784+879, SEQ ID NOs: 785+880, SEQ ID NOs: 786+881, SEQ ID NOs: 787+882, SEQ ID NOs: 788+883, SEQ ID NOs: 789+884, SEQ ID NOs: 790+885, SEQ ID NOs: 791+886, SEQ ID NOs: 792+887, SEQ ID NOs: 793+888, SEQ ID NOs: 794+889, SEQ ID NOs: 795+890, SEQ ID NOs: 796+891, SEQ ID NOs: 797+892, SEQ ID NOs: 798+893, SEQ ID NOs: 799+894, and SEQ ID NOs: 800+895; all pairs grouped into bin 2;

(3) a heavy and light chain as depicted in SEQ ID NOs: 656+692, SEQ ID NOs: 654+690, SEQ ID NOs: 664+700, SEQ ID NOs: 670+706, SEQ ID NOs: 738+833, SEQ ID NOs: 739+834, SEQ ID NOs: 740+835, SEQ ID NOs: 741+836, SEQ ID NOs: 742+837, SEQ ID NOs: 743+838, SEQ ID NOs: 744+839, SEQ ID NOs: 745+840, SEQ ID NOs: 746+841, SEQ ID NOs: 763+858, SEQ ID NOs: 764+859, SEQ ID NOs: 765+860, SEQ ID NOs: 766+861, SEQ ID NOs: 767+862, SEQ ID NOs: 768+863, SEQ ID NOs: 779+874, and SEQ ID NOs: 780+875; all pairs grouped into bin 3;

(4) a heavy and light chain as depicted in SEQ ID NOs: 640+676, SEQ ID NOs: 642+678, SEQ ID NOs: 646+682, SEQ ID NOs: 648+684, SEQ ID NOs: 666+702, SEQ ID NOs: 725+820, SEQ ID NOs: 726+821, SEQ ID NOs: 727+822, SEQ ID NOs: 728+823, SEQ ID NOs: 729+824, SEQ ID NOs: 730+825, SEQ ID NOs: 731+826, SEQ ID NOs: 732+827, SEQ ID NOs: 733+828, SEQ ID NOs: 734+829, SEQ ID NOs: 735+830, SEQ ID NOs: 736+831, SEQ ID NOs: 737+832, SEQ ID NOs: 750+845, SEQ ID NOs: 751+846, SEQ ID NOs: 752+847, SEQ ID NOs: 753+848, SEQ ID NOs: 775+870, SEQ ID NOs: 776+871, SEQ ID NOs: 777+872, SEQ ID NOs: 778+873, SEQ ID NOs: 802+897, SEQ ID NOs: 803+898, SEQ ID NOs: 804+899, and SEQ ID NOs: 805+900; all pairs grouped into bin 4; and (5) a heavy and light chain as depicted in SEQ ID NOs: 652+688, and SEQ ID NOs: 769+864 all pairs grouped into bin 5.

In another embodiment the invention is directed to an antibody construct comprising the human antibody or antigen binding fragment thereof capable of binding to human CDH19 on the surface of a target cell as described above that is conjugated to a chemotherapeutic agent.

In one embodiment of the antibody construct of the invention a linker conjugates the chemotherapeutic agent to the human antibody or antigen binding fragment thereof. Accordingly, embodiments of the antibody construct comprising of the invention include antibody drug conjugates (ADCs). Generally the antibody construct comprising of the invention comprises an antibody conjugated to a chemotherapeutic agent, e.g., a cytotoxic agent, a cytostatic agent, a toxin, or a radioactive agent. A linker molecule can be used to conjugate the drug to the antibody. A wide variety of linkers and drugs useful e.g. in ADC technology are known in the art and may be used in embodiments of the present invention. (See US20090028856; US2009/0274713; US2007/0031402; WO2005/084390; WO2009/099728; U.S. Pat. No. 5,208,020; U.S. Pat. No. 5,416,064; U.S. Pat. Nos. 5,475,092; 5,585,499; 6,436,931; 6,372,738; and 6,340,701, all incorporated herein by reference).

In certain embodiments, the antibody construct comprising of the invention comprises a linker made up of one or more linker components. Exemplary linker components include 6-maleimidocaproyl, maleimidopropanoyl, valine-citrulline, alanine-phenylalanine, p-aminobenzyloxycarbonyl, and those resulting from conjugation with linker reagents, including, but not limited to, N-succinimidyl 4-(2-pyridylthio) pentanoate ("SPP"), N-succinimidyl 4-(N-maleimidomethyl) cyclohexane-1 carboxylate ("SMCC," also referred to herein also as "MCC"), and N-succinimidyl (4-iodo-acetyl) aminobenzoate ("SIAB"). Linkers may be a "cleavable" linker or a "non-cleavable" linker (Ducry and Stump, *Bioconjugate Chem.* 2010, 21, 5-13; incorporated herein by reference in its entirety) Cleavable linkers are designed to release the drug when subjected to certain environment factors, e.g., when internalized into the target cell. Cleavable linkers include acid labile linkers, protease sensitive linkers, photolabile linkers, dimethyl linker or disulfide-containing linkers. Non-cleavable linkers tend to remain covalently associated with at least one amino acid of the antibody and the drug upon internalization by and degradation within the target cell. An exemplary non-cleavable linker is MCC.

In a preferred embodiment of the antibody construct of the invention the linker is a non-cleavable linker.

It is also preferred that the linker in the antibody construct of the invention comprises MCC.

In a further embodiment of the antibody construct of the invention the chemotherapeutic agent is conjugated to one or more lysines contained in the human antibody or antigen binding fragment thereof.

In certain embodiments, the antibody of the invention is conjugated to a chemotherapeutic agent. Examples of chemotherapeutic agents include alkylating agents, such as thiotepa and cyclophosphamide (CYTOXAN™); alkyl sulfonates such as busulfan, improsulfan and piposulfan; aziridines, such as benzodopa, carboquone, meturedopa, and uredopa; ethylenimines and methylamelamines including altretamine, triethylenemelamine, trietylenephosphoramide, triethylenethiophosphaoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CBI-TMI); eleutherobin; pancratistatin; a sarcodictyin; spongistatin; nitrogen mustards such as chlorambucil, chlomaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics, such as the enediyne antibiotics (e.g. calicheamicin, especially calicheamicin .gamma1 and calicheamicin theta I, see, e.g., Angew Chem. Intl. Ed. Engl. 33:183-186 (1994); dynemicin, including dynemicin A; an esperamicin; as well as neocarzinostatin chromophore and related chromoprotein enediyne antiobiotic chromomophores), aclacinomysins, actinomycin, authramycin, azaserine, bleomycins, cactinomycin, carabicin, caminomycin, carzinophilin; chromomycins, dactinomycin, daunorubicin, detorubicin, 6-diazo-5-oxo-L-norleucine, doxorubicin (including morpholino-doxorubicin, cyanomorpholino-doxorubicin, 2-pyrrolino-doxorubicin and deoxydoxorubicin), epirubicin, esorubicin, idarubicin, marcellomycin, nitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites, such as methotrexate and 5-fluorouracil (5-FU); folic acid analogues, such as denopterin, methotrexate, pteropterin, trimetrexate; purine analogs, such as fludarabine, 6-mercaptopurine, thiamiprine, thioguanine; pyrimidine analogs such as, ancitabine, azacitidine, 6-azauridine, carmofur, cytarabine, dideoxyuridine, doxifluridine, enocitabine, floxuridine, 5-FU; androgens, such as calusterone, dromostanolone propionate, epitiostanol, mepitiostane, testolactone; anti-adrenals, such as aminoglutethimide, mitotane, trilostane; folic acid replenisher, such as frolinic acid; aceglatone; aldophosphamide glycoside; aminolevulinic acid; amsacrine; bestrabucil; bisantrene; edatraxate; defofamine; demecolcine; diaziquone; elfomithine; elliptinium acetate; an epothilone; etoglucid; gallium nitrate; hydroxyurea; lentinan; lonidamine; maytansinoids, such as maytansine and ansamitocins; mitoguazone; mitoxantrone; mopidamol; nitracrine; pentostatin; phenamet; pirarubicin; podophyllinic acid; 2-ethylhydrazide; procarbazine; PSK®; razoxane; rhizoxin; sizofuran; spirogermanium; tenuazonic acid; triaziquone; 2,2',2''-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g. paclitaxel (TAXOL™, Bristol-Myers Squibb Oncology, Princeton, N.J.) and doxetaxel (TAXOTERE®, Rhone-Poulenc Rorer, Antony, France); chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; 65 daunomycin; aminopterin; xeloda; ibandronate; CPT-11; topoisomerase inhibitor RFS 2000; difluoromethylornithine (DMFO); retinoic acid; capecitabine; and pharmaceutically acceptable salts, acids or derivatives of any of the above. Also included in this definition are anti-hormonal agents that act to regulate or inhibit hormone action on tumors, such as anti-estrogens including for example tamoxifen, raloxifene, aromatase inhibiting 4(5)-imidazoles, 4-hydroxytamoxifen, trioxifene, keoxifene, LY117018, onapristone, and toremifene (Fareston); and anti-androgens, such as flutamide, nilutamide, bicalutamide, leuprolide, and goserelin; siRNA and pharmaceutically acceptable salts, acids or derivatives of any of the above. Other chemotherapeutic agents that can be used with the present invention are disclosed in US Publication No. 20080171040 or US Publication No. 20080305044 and are incorporated in their entirety by reference.

It is contemplated that an antibody may be conjugated to two or more different chemotherapeutic agents or a pharmaceutical composition may comprise a mixture of antibodies wherein the antibody component is identical except for being conjugated to a different chemotherapeutic agent. Such embodiments may be useful for targeting multiple biological pathways with a target cell.

In preferred embodiments, the antibody construct comprising of the invention comprises an antibody conjugated to one or more maytansinoid molecules, which are mitotic inhibitors that act by inhibiting tubulin polymerization.

Maytansinoids, including various modifications, are described in U.S. Pat. Nos. 3,896,111; 4,151,042; 4,137,230; 4,248,870; 4,256,746; 4,260,608; 4,265,814; 4,294,757; 4,307,016; 4,308,268; 4,309,428; 4,313,946; 4,315,929; 4,317,821; 4,322,348; 4,331,598; 4,361,650; 4,364,866; 4,424,219; 4,450,254; 4,362,663; 4,371,533; and WO 2009/099728. Maytansinoid drug moieties may be isolated from natural sources, produced using recombinant technology, or prepared synthetically. Exemplary maytansinoids include C-19-dechloro (U.S. Pat. No. 4,256,746), C-20-hydroxy (or C-20-demethyl)+/−C-19-dechloro (U.S. Pat. Nos. 4,307,016 and 4,361,650), C-20-demethoxy (or C-20-acyloxy (—OCOR), +/−dechrolo (U.S. Pat. No. 4,294,757), C-9-SH (U.S. Pat. No. 4,424,219), C-14-alkoxymethyl (demethoxy/CH2OR) (U.S. Pat. No. 4,331,598), C-14-hydroxymethyl or acyloxymethyl (CH2OH or CH2OAc) (U.S. Pat. No. 4,450,254), C-15-hydroxy/acyloxy (U.S. Pat. No. 4,364,866), C-15-methoxy (U.S. Pat. Nos. 4,313,946 and 4,315,929), C-18-N-demethyl (U.S. Pat. Nos. 4,362,663 and 4,322,348), and 4,5-deoxy (U.S. Pat. No. 4,371,533).

Various positions on maytansinoid compounds may be used as the linkage position, depending upon the type of link desired. For example, for forming an ester linkage, the C-3 position having a hydroxyl group, the C-14 position modified with hydrozymethyl, the C-15 position modified with a hydroxyl a group, and the C-20 position having a hydroxyl group are all suitable (U.S. Pat. Nos. 5,208,020, RE39151, and 6,913,748; US Patent Appl. Pub. Nos. 20060167245 and 20070037972, and WO 2009099728).

Preferred maytansinoids include those known in the art as DM1, DM3, and DM4 (US Pat. Appl. Pub. Nos. 2009030924 and 20050276812, incorporated herein by reference).

In one embodiment of the antibody construct of the invention the chemotherapeutic agent is DM1. Accordingly, in a preferred embodiment the antibody construct of the invention is an the human antibody or antigen binding fragment thereof conjugated to one or more DM1 molecules.

ADCs containing maytansinoids, methods of making such ADCs, and their therapeutic use are disclosed in U.S. Pat. Nos. 5,208,020 and 5,416,064, US Pat. Appl. Pub. No. 20050276812, and WO 2009099728 (all incorporated by reference herein). Linkers that are useful for making maytansinoid ADCs are know in the art (U.S. Pat. No. 5,208,020 and US Pat. Appl. Pub. Nos. 2005016993 and 20090274713; all incorporated herein by reference). Maytansinoid ADCs comprising an SMCC linker may be prepared as disclosed in US Pat. Publ. No. 2005/0276812.

In certain embodiments, the antibody construct comprising of the invention comprises an antibody conjugated to DM1 with an SMCC linker.

An antibody construct comprising of the invention may have 1 to 20 chemotherapeutic agents per antibody. Compositions of ADCs may be characterized by the average number of drug moieties per antibody molecule in the composition. The average number of drug moieties may be determined by conventional means such as mass spectrometry, immunoassay, and HPLC. In some instances, a homogeneous ADC population may be separated and purified by means of reverse phase HPLC or electrophoresis. Thus, pharmaceutical ADC compositions may contain a heterogeneous or homogeneous population of antibodies linked to 1, 2, 3, 4, 5, 6, 7 or more drug moieties.

Thus, in a preferred embodiment of the antibody construct of the invention the average number of DM1 molecules per antibody construct is between 1 and 10.

It is also preferred for the antibody construct of the invention that the average number of DM1 molecules per antibody construct is between 3 and 7.

Moreover, it is preferred for the antibody construct of the invention that the average number of DM1 molecules per antibody construct is between 4 and 6.

Embodiments of the invention include antibody constructs comprising an average of about 1, about 2, about 3, about 4, about 5, about 6, about 7, about 8, about 9, about 10, about 11, about 12, about 13, about 14, about 15, about 16, about 17, about 18, about 19, or about 20 DM1 molecules per antibody.

In a further alternative embodiment of the antibody construct of the invention the average number of DM1 molecules per antibody construct is about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0.

In one embodiment the antibody respectively the antibody construct of the invention comprises an effector function-enhanced antibody. One of the functions of the Fc portion of an antibody is to communicate to the immune system when the antibody binds its target. This is considered "effector function". Communication leads to antibody-dependent cellular cytotoxicity (ADCC), antibody-dependent cellular phagocytosis (ADCP), and/or complement dependent cytotoxicity (CDC). ADCC and ADCP are mediated through the binding of the Fc to Fc receptors on the surface of cells of the immune system. CDC is mediated through the binding of the Fc with proteins of the complement system, e.g., C1q.

The IgG subclasses vary in their ability to mediate effector functions. For example IgG1 is much superior to IgG2 and IgG4 at mediating ADCC and CDC. Thus, in embodiments wherein a cell expressing CDH19 is targeted for destruction, an anti-CDH19 IgG1 antibody would be preferred.

The effector function of an antibody can be increased, or decreased, by introducing one or more mutations into the Fc. Embodiments of the invention include antigen binding proteins, e.g., antibodies, having an Fc engineered to increase effector function (U.S. Pat. No. 7,317,091 and Strohl, Curr. Opin. Biotech., 20:685-691, 2009; both incorporated herein by reference in its entirety). Exemplary IgG1 Fc molecules having increased effector function include (based on the Kabat numbering scheme) those have the following substitutions:

S239D/I332E
S239D/A330S/I332E
S239D/A330L/I332E
S298A/D333A/K334A
P247I/A339D
P247I/A339Q
D280H/K290S
D280H/K290S/S298D
D280H/K290S/S298V
F243L/R292PN300L
F243L/R292PN300L/P396L
F243L/R292P1Y300L/V3051/P396L
G236A/S239D/I332E
K326A/E333A
K326W/E333S
K290E/S298G/T299A
K290N/S298G/T299A
K290E/S298G/T299A/K326E
K290N/S298G/T299A/K326E

Further embodiments of the invention include antibodies, having an Fc engineered to decrease effector function.

Exemplary Fc molecules having decreased effector function include (based on the Kabat numbering scheme) those have the following substitutions:

N297A (IgG1)
L234A/L235A (IgG1)
V234A/G237A (IgG2)
L235A/G237A/E318A (IgG4)
H268Q/V309L/A330S/A331S (IgG2)
C220S/C226S/C229S/P238S (IgG1)
C226S/C229S/E233P/L234V/L235A (IgG1)
L234F/L235E/P331 S (IgG1)
S267E/L328F (IgG1)

Another method of increasing effector function of IgG Fc-containing proteins is by reducing the fucosylation of the Fc. Removal of the core fucose from the biantennary complex-type oligosachharides attached to the Fc greatly increased ADCC effector function without altering antigen binding or CDC effector function. Several ways are known for reducing or abolishing fucosylation of Fc-containing molecules, e.g., antibodies. These include recombinant expression in certain mammalian cell lines including a FUT8 knockout cell line, variant CHO line Lec13, rat hybridoma cell line YB2/0, a cell line comprising a small interfering RNA specifically against the FUT8 gene, and a cell line coexpressing B-1,4-N-acetylglucosaminyltransferase III and Golgi α-mannosidase II. Alternatively, the Fc-containing molecule may be expressed in a non-mammalian cell such as a plant cell, yeast, or prokaryotic cell, e.g., E. coli. Thus, in certain embodiments of the invention, a composition comprises an antibody, e.g., Ab1, Ab2, Ab3, Ab4, Ab5, Ab6, Ab7, or Ab8, having reduced fucosylation or lacking fucosylation altogether.

The invention further provides an isolated nucleic acid molecule or sequence encoding a human antibody or antigen binding fragment thereof of the invention.

Furthermore, the invention provides a vector comprising a nucleic acid sequence of the invention. Moreover, the invention provides a host cell transformed or transfected with the nucleic acid sequence of the invention or with a vector comprising the nucleic acid molecule.

In a further embodiment the invention provides a process for the production of a human antibody or an antigen binding fragment thereof of the invention, said process comprising culturing a host cell of the invention under conditions allowing the expression of the human antibody or antigen binding fragment thereof of the invention and recovering the produced antibody or antigen binding fragment thereof from the culture.

In a further embodiment the invention provides a process for the production of an antibody construct comprising a human antibody or an antigen binding fragment thereof of the invention, said process comprising culturing a host cell of the invention under conditions allowing the expression of the human antibody or antigen binding fragment thereof of the invention and recovering the produced antibody or antigen binding fragment thereof from the culture, and conjugating a chemotherapeutic agent to the recovered antibody or antigen binding fragment thereof to produce the antibody conjugate.

Moreover, the invention provides a pharmaceutical composition comprising a human antibody or antigen binding fragment thereof of the invention or an antibody construct of the invention or produced according to the process of the invention in admixture with a pharmaceutically acceptable carrier thereof.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

Those "in need of treatment" include those already with the disorder, as well as those in which the disorder is to be prevented. The term "disease" is any condition that would benefit from treatment with the protein formulation described herein. This includes chronic and acute disorders or diseases including those pathological conditions that predispose the mammal to the disease in question. Non-limiting examples of diseases/disorders to be treated herein include proliferative disease, a tumorous disease, or an immunological disorder.

In some embodiments, the invention provides a pharmaceutical composition comprising a therapeutically effective amount of one or a plurality of the a human antibody or antigen binding fragment thereof of the invention or an antibody construct of the invention together with a pharmaceutically effective diluents, carrier, solubilizer, emulsifier, preservative, and/or adjuvant. In certain embodiments, the antigen binding protein is an antibody, including a drug-conjugated antibody or a bispecific antibody. Pharmaceutical compositions of the invention include, but are not limited to, liquid, frozen, and lyophilized compositions.

Preferably, formulation materials are nontoxic to recipients at the dosages and concentrations employed. In specific embodiments, pharmaceutical compositions comprising a therapeutically effective amount of a human antibody or antigen binding fragment thereof of the invention or an antibody construct of the invention.

In certain embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine, proline, or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, REMINGTON'S PHARMACEUTICAL SCIENCES, 18" Edition, (A. R. Genrmo, ed.), 1990, Mack Publishing Company.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antigen binding proteins of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In specific embodiments, pharmaceutical compositions comprise Tris buffer of about pH 7.0-8.5, or acetate buffer of about pH 4.0-5.5, and may further include sorbitol or a suitable substitute therefore. In certain embodiments of the invention, human antibody or antigen binding fragment thereof of the invention or the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the human antibody or antigen binding fragment thereof of the invention or the antibody construct of the invention may be formulated as a lyophilizate using appropriate excipients such as sucrose.

The pharmaceutical compositions of the invention can be selected for parenteral delivery. Alternatively, the compositions may be selected for inhalation or for delivery through the digestive tract, such as orally. Preparation of such pharmaceutically acceptable compositions is within the skill of the art. The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions for use in this invention may be provided in the form of a pyrogen-free, parenterally acceptable aqueous solution comprising the desired human antibody or antigen binding fragment thereof of the invention or the antibody construct of the invention in a pharmaceutically acceptable vehicle. A particularly suitable vehicle for parenteral injection is sterile distilled water in which the human antibody or antigen binding fragment thereof of the invention or the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antigen binding protein.

Additional pharmaceutical compositions will be evident to those skilled in the art, including formulations involving human antibody or antigen binding fragment thereof of the invention or the antibody construct of the invention in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., 1983, *Biopolymers* 2:547-556), poly (2-hydroxyethyl-methacrylate) (Langer et al., 1981, *J. Biomed. Mater. Res.* 15:167-277 and Langer, 1982, *Chem. Tech.* 12:98-105), ethylene vinyl acetate (Langer et al., 1981, supra) or poly-D(-)-3-hydroxybutyric acid (European Patent Application Publication No. EP 133,988). Sustained release compositions may also include liposomes that can be prepared by any of several methods known in the art. See, e.g., Eppstein et al., 1985, *Proc. Natl. Acad. Sci. U.S.A.* 82:3688-3692; European Patent Application Publication Nos. EP 036,676; EP 088,046 and EP 143,949, incorporated by reference.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Aspects of the invention includes self-buffering human antibody or antigen binding fragment thereof of the invention or the antibody construct of the invention formulations, which can be used as pharmaceutical compositions, as described in international patent application WO 06138181A2 (PCT/US2006/022599), which is incorporated by reference in its entirety herein.

As discussed above, certain embodiments provide human antibody or antigen binding fragment thereof of the invention or the antibody construct of the invention protein compositions, particularly pharmaceutical compositions of the invention, that comprise, in addition to the human antibody or antigen binding fragment thereof of the invention or the antibody construct of the invention, one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution," in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions," Pharm Biotechnol. 13: 159-75 (2002), each of which is herein incorporated by reference in its entirety, particularly in parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention.

As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic." Destabilizing solutes are referred to as "chaotropic." Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in human antibody or antigen binding fragment thereof of the invention or the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations.

Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the human antibody or antigen binding fragment thereof of the invention or the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product.

Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188.

Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of human antibody or antigen binding fragment thereof of the invention or the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard.

Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins.

Magnesium ions (10-120 mM) can be used to inhibit isomerization of aspartic acid to isoaspartic acid. Ca+2 ions (up to 100 mM) can increase the stability of human deoxyribonuclease. Mg+2, Mn+2, and Zn+2, however, can destabilize rhDNase. Similarly, Ca+2 and Sr+2 can stabilize Factor VIII, it can be destabilized by Mg+2, Mn+2 and Zn+2, Cu+2 and Fe+2, and its aggregation can be increased by Al+3 ions.

Embodiments of the human antibody or antigen binding fragment thereof of the invention or the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer antimicrobial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

Human antibody or antigen binding fragment thereof of the invention or the antibody construct of the invention generally will be designed for specific routes and methods of administration, for specific administration dosages and frequencies of administration, for specific treatments of specific diseases, with ranges of bio-availability and persistence, among other things. Formulations thus may be designed in accordance with the invention for delivery by any suitable route, including but not limited to orally, aurally, opthalmically, rectally, and vaginally, and by parenteral routes, including intravenous and intraarterial injection, intramuscular injection, and subcutaneous injection.

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. The invention also provides kits for producing a single-dose administration unit. The kits of the invention may each contain both a first container having a dried protein and a second container having an aqueous formulation. In certain embodiments of this invention, kits containing single and multi-chambered pre-filled syringes (e.g., liquid syringes and lyosyringes) are provided. The therapeutically effective amount of a human antibody or antigen binding fragment thereof of the invention or the antibody construct of the invention protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the human antibody or antigen binding fragment thereof of the invention or the antibody construct of the invention is being used, the route of administration, and the size (body weight, body surface or organ size) and/or condition (the age and general health) of the patient. In certain embodiments, the clinician may titer the dosage and modify the route of administration to obtain the optimal therapeutic effect. A typical dosage may range from about 0.1 μg/kg to up to about 30 mg/kg or more, depending on the factors mentioned above. In specific embodiments, the dosage may range from 1.0 μg/kg up to about 20 mg/kg, optionally from 10 μg/kg up to about 10 mg/kg or from 100 μg/kg up to about 5 mg/kg.

A therapeutic effective amount of a human antibody or antigen binding fragment thereof of the invention or the antibody construct of the invention preferably results in a decrease in severity of disease symptoms, in increase in frequency or duration of disease symptom-free periods or a prevention of impairment or disability due to the disease affliction. For treating CDH19-expressing tumors, a therapeutically effective amount of human antibody or antigen binding fragment thereof of the invention or the antibody construct of the invention, e.g. an anti-CDH19 antibody construct (ADC construct), preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

Pharmaceutical compositions may be administered using a medical device. Examples of medical devices for administering pharmaceutical compositions are described in U.S.

Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163, all incorporated by reference herein.

In one embodiment the invention provides the human antibody or antigen binding fragment thereof of the invention, the antibody construct of the invention, or produced according to the process of the invention for use in the prevention, treatment or amelioration of a melanoma disease or metastatic melanoma disease. Preferably, the melanoma disease or metastatic melanoma disease is selected from the group consisting of superficial spreading melanoma, lentigo maligna, lentigo maligna melanoma, acral lentiginous melanoma and nodular melanoma.

The invention also provides a method for the treatment or amelioration of a melanoma disease or metastatic melanoma disease, comprising the step of administering to a subject in need thereof the antibody or antigen binding fragment thereof of the invention, the antibody construct of the invention, an antibody or antigen binding fragment thereof of the invention or the antibody construct of the invention produced according to the process of the invention or a pharmaceutical composition of the invention.

In a preferred embodiment method the invention the melanoma disease or metastatic melanoma disease is selected from the group consisting of superficial spreading melanoma, lentigo maligna, lentigo maligna melanoma, acral lentiginous melanoma and nodular melanoma.

In a further embodiment, the invention provides a kit comprising an antibody or antigen binding fragment thereof of the invention, an antibody construct of the invention, an antibody or antigen binding fragment thereof of the invention or the antibody construct produced according to the process of the invention, a vector of the invention, and/or a host cell of the invention.

It should be understood that the inventions herein are not limited to particular methodology, protocols, or reagents, as such can vary. The discussion and examples provided herein are presented for the purpose of describing particular embodiments only and are not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

EXAMPLES

The following examples illustrate the invention. These examples should not be construed as to limit the scope of this invention. The examples are included for purposes of illustration, and the present invention is limited only by the claims.

Example 1—Fully Human Monoclonal Antibodies Against CDH19

1.1 Immunization

Fully human antibodies to Cadherin-19 (CDH19) were generated using XENOMOUSE® technology, transgenic mice engineered to express diverse repertoires of fully human IgGκ and IgGλ antibodies of the corresponding isotype. (U.S. Pat. Nos. 6,114,598; 6,162,963; 6,833,268; 7,049,426; 7,064,244, which are incorporated herein by reference in their entirety; Green et al., 1994, *Nature Genetics* 7:13-21; Mendez et al., 1997, *Nature Genetics* 15:146-156; Green and Jakobovitis, 1998, *J. Ex. Med.* 188:483-495; Kellermann and Green, *Current Opinion in Biotechnology* 13, 593-597, 2002).

Mice were immunized with multiple forms of Cadherin-19 immunogen, including: (1) full length human and cynomologous ("cyno") monkey cadherin-19, (2) secreted Cadherin-19 ecto-domain (amino acids 1-596), and (3) a truncated membrane bound form of human cadherin-19 (amino acids 1-624). Mice were immunized over a period of 8 to 10 weeks with a range of 16-18 boosts.

Sera were collected at approximately 5 and 9 weeks after the first injection and specific titers were determined by FACs staining of recombinant Cadherin-19 receptor transiently expressed on CHO-S cells. A total of 37 animals were identified with specific immune responses, these animals were pooled into 3 groups and advanced to antibody generation.

1.2 Preparation of Monoclonal Antibodies

Animals exhibiting suitable titers were identified, and lymphocytes were obtained from draining lymph nodes and, if necessary, pooled for each cohort. Lymphocytes were dissociated from lymphoid tissue by grinding in a suitable medium (for example, Dulbecco's Modified Eagle Medium (DMEM); obtainable from Invitrogen, Carlsbad, Calif.) to release the cells from the tissues, and suspended in DMEM. B cells were selected and/or expanded using standard methods, and fused with suitable fusion partner using techniques that were known in the art.

After several days of culture, the hybridoma supernatants were collected and subjected to screening assays as detailed in the examples below, including confirmation of binding to human and cynomologous monkey as well as the ability to kill cell lines in secondary antibody-drug conjugate Bioassays. Hybridoma lines that were identified to have the binding and functional properties of interest were then further selected and subjected to standard cloning and subcloning techniques. Clonal lines were expanded in vitro, and the secreted human antibodies obtained for analysis and V gene sequencing was performed.

1.3 Selection of Cadherin-19 Receptor Specific Binding Antibodies by FMAT

After 14 days of culture, hybridoma supernatants were screened for CDH19-specific monoclonal antibodies by Fluorometric Microvolume Assay Technology (FMAT) (Applied Biosystems, Foster City, Calif.). The supernatants were screened against adherent CHO cells transiently transfected with human Cadherin-19 and counter screened against CHO cells transiently transfected with the same expression plasmid that did not contain the Cadherin-19 gene.

After multiple screening campaigns, a panel of 1570 anti-Cadherin-19 binding hybridoma lines were identified and advanced to further characterization assays.

Example 2—Assessment of Fully Human Monoclonal Antibodies Against CDH19

2.1 Additional Binding Characterization by Flow Cytometry (FACs

FACS binding assays were performed to evaluate the binding of the anti-Cadherin-19 receptor specific antibodies to endogenous Cadherin-19 receptor expressed on the CHL-1 tumor cell lines. In addition, cross-reactive binding to murine and cynomologous monkey Cadherin-19 orthologues was also evaluated by FACs using recombinant forms of the various receptors transiently expressed on 293T cells.

FACs assays were performed by incubating hybridoma supernatants with 10,000 to 25,000 cells in PBS/2% Fetal bovine serum/2 mM Calcium Chloride at 4° C. for one hour followed by two washes with PBS/2% Fetal bovine serum/2 mM Calcium Chloride. Cells were then treated with florochrome-labeled secondary antibodies at 4° C. followed by one wash. The cells were resuspended in 50 μl of PBS/2% FBS and antibody binding was analyzed using a FACSCalibur™ instrument.

2.2 Antibody Drug Conjugate Screening of Fully Human Antibodies Derived from XenoMouse® Hybridomas Cell killing through antibody drug conjugates requires the delivery of the conjugate into a cell through internalization and the catabolism of the drug-conjugate into a form that it is toxic to the cell. To identify antibodies with these properties, CDH19-positive cell lines (Colo-699 or CHL-1) were seeded at low cell densities and allowed to adhere overnight in a 384 well plate. XENOMOUSE® hybridoma samples containing fully human anti-CDH19 antibodies were then added to these cells in the presence of a high concentration of a goat anti-human Fc monovalent Fab conjugated with DM1 (DM1-Fab) at a relatively low drug-antibody ratio (DAR) (~1.3). The cells were incubated for 96 hours at 37° C. and 5% $CO_2$ in the presence of the antibody samples and the DM1-Fab. At the end of this time, the cell viability was assessed using the CellTiter-Glo® Luminescent Cell Viability reagent (Promega) according to manufacturer's recommendations.

Figure 2:
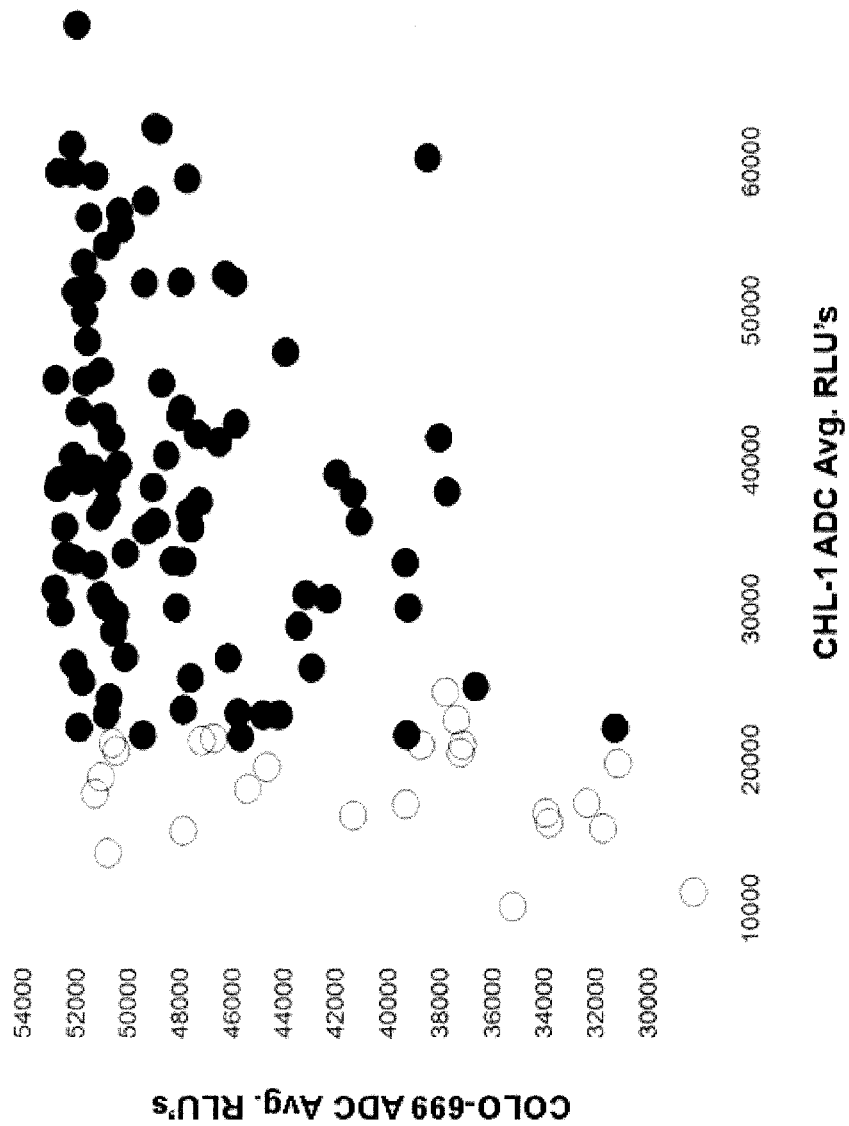
FIG. 2 depicts the average cell viability data from a CHL-1 assay plotted against the average cell viability data from the Colo-699 assay.

An example of the cell viability data with the Colo-699 cells is shown in FIG. 1 and FIG. 2. The antibodies capable of delivering the DM1-Fab to the cells and inhibiting the cell growth read out with a lower luminescent signal (RLU). The top antibodies of interest from this screen are observed in the lower left corner of FIG. 1 and are denoted as open circles.

These antibodies were taken forward into a cell viability assay on CHL-1 cells. The average cell viability data from the CHL-1 assay is plotted against the average cell viability data from the Colo-699 assay (FIG. 2). The antibodies that had activity on both the Colo-699 and the CHL-1 cells are denoted as open circles on the left-hand side of the FIG. 2. This assay was run concurrently with the FACs antibody binding assay above (2.2), and the results from these two studies were used to select the antibodies for further characterization. In total, 1570 antibodies were run through these cell based viability assays and approximately 44 antibodies were selected on the bases of in vitro cell killing and/or antibody binding for sub-cloning, V gene sequencing and expressed in recombinant form for further characterization assays as described below.

These 44 antibodies were again assayed as in Example 2 and 19 antibodies were selected that contained unique sequences. Of these 19 antibodies, 18 antibodies were analyzed and their properties characterized in Table 2 below. The data in this table was generated using FACs binding on recombinant human and cynomologous CDH-19, +/−Calcium ($Ca^{+2}$) binding data on 293/CDH-19 transfectants, binding to endogenous CDH-19 on CHL-1 and Colo699 tumor cells and competition with the antibody designated as 4A9 in the table. These experiments provided the further characterizations for the grouping of these antibodies into 5 groups or bins.

TABLE 2

| | | | |
|---|---|---|---|
| Binning of Lead panel using Antibody Binding Information | | | |
| Bin ID | LMR Sequence/ Ab ID | Clone ID | Bin Characteristics |
| 1 | 13589 | 4A9 | High Endogenous binding, Calcium |
| | 13591 | 4F7 | insensitive, sequence clustered, moderate cyno complete 4A9 competitor |
| 2 | 13885 | 19B5 | High Endogenous binding, Calcium |
| | 13880 | 25F8 | insensitive, sequence clustered, Good cyno, |
| | 13882 | 26D1 | partial 4A9 competitor |
| | 13881 | 26F12 = 27B3 | |
| | 13878 | 16H2 = 20D3 = 23E7 | |
| | 13879 | 22D1 | |
| 3 | 13877 | 22G10 | High Endogenous binding, moderate 293 |
| | 13874 | 17H8 = 23B6 = 28D10 | binding, Calcium insensitive, 2 sequence |
| | 13883 | 25G10 | clusters, moderate cyno, partial |
| | 13875 | 16C1 | 4A9 competitor, 22G10 best binder in bin. |
| 4 | 13590 | 4B10 | Low Endogenous and recombinant binding, |
| | 13586 | 4F3 | Calcium sensitive, sequence diverse group, |
| | 13592 | 4A2 | comparable cyno, No 4A9 competition |
| | 13884 | 23A10 | |
| | 13588 | 2G6 | |
| 5 | 13876 | 16A4 | Best endogenous binder, moderate recombinant binder, calcium insensitive, very weak cyno, No 4A9 competition. |

Of these 18 antibodies. 8 antibodies were selected for further analysis of their epitope binding as described below. At least one representative antibody from each bin was selected for further analysis.

Example 3—Epitope Prediction

Epitope Prediction by 4A9 Antibody Competition and by Human/Mouse Cadherin-19 Chimeras A 4A9 binding competition method was developed to identify antibodies that compete with 4A9 binding. In 96-well V-bottom plates (Sarstedt #82.1583.001), 50,000 transiently transfected 293T cells were incubated with 5 ug/ml of purified anti-CDH19 antibodies for 1 hr at 4° C. followed by one wash with PBS/2% FBS. 25 µl of 5 µg/ml Alexa647-labelled 4A9 was then added to each well and the plates incubated for 1 hour at 4° C. Cells were then washed two times and the amount of cell associated Alexa647-labelled 4A9 was quantitated by flow cytometry.

The experiments included negative controls consisting of PBS/2% FBS only. The average signal observed in these negative control experiments was adopted as the maximum possible signal for the assay. Antibodies were compared to this maximum signal and a percent inhibition was calculated for each well (% Inhibition=(1−(FL4 Geomean with the anti-CDH19 antibodies/Maximum FL4 Geomean signal)).

Domain binding was determined by flow cytometry as above on 293T cells transiently transfected with plasmids consisting of single or dual human CDH19 cadherin repeat domain replacements into the mouse Cadherin19 backbone cloned into the pTT5 expression vector immediately preceded by native human or murine CDH19 leader sequences and a Flag tag (SEQ ID NO: 968). The experiment included assaying the anti-CDH19 antibodies against mouse Cadherin19 to determine suitability for binning on these human/mouse chimeras. The data from these experiments are presented in the Table below entitled as follows:

TABLE 3

Calcium Sensitive Binding and Epitope Prediction Summary

| Clone ID | Ab ID | Bin | Ca2+ Sensitive Binding | Competes with 4A9 (13589) | Hu EC1-5 A | Hu EC1 B | Hu EC1-2 C | Hu EC2 D | Hu EC2-3 E | Hu EC3 F | Hu EC4-5 G | Hu EC5 H | Mu EC1-5 I | Predicted Epitope Region |
|---|---|---|---|---|---|---|---|---|---|---|---|---|---|---|
| 4A9 | 13589 | 1 | No | Yes | + | + | + | − | − | − | − | − | − | 44-141 |
|  | 14056 | 1 | No | Yes | + | + | + | − | − | − | − | − | − |  |
|  | 14057 | 1 | No | Yes | + | + | + | − | − | − | − | − | − |  |
| 25F8 | 13880 | 2 | No | Yes | + | + | + | − | − | − | − | − | − |  |
|  | 14094 | 2 | No | Yes | + | + | + | − | − | − | − | − | − |  |
|  | 14096 | 2 | No | Yes | + | + | + | − | − | − | − | − | − |  |
| 26D1 | 13882 | 2 | No | Yes | + | + | + | − | − | − | − | − | − |  |
|  | 14088 | 2 | No | Yes | + | + | + | − | − | − | − | − | − |  |
| 17H8 | 13874 | 3 | No | Yes | + | + | + | − | − | − | − | − | − |  |
|  | 14045 | 3 | No | Yes | + | + | + | − | − | − | − | − | − |  |
|  | 14048 | 3 | No | Yes | + | + | + | − | − | − | − | − | − |  |
| 4A2 | 13592 | 4 | Yes | No | + | − | − | − | + | + | − | − | − | 250-364 |
|  | 14026 | 4 | Yes | No | + | − | − | − | + | + | − | − | − |  |
| 4B10 | 13590 | 4 | Yes | No | + | − | − | − | + | + | − | − | − |  |
|  | 14055 | 4 | Yes | No | + | − | − | − | + | + | − | − | − |  |
|  | 14054 | 4 | Yes | No | + | − | − | − | + | + | − | − | − |  |
| 2G6 | 13588 | 4 | Yes | No | + | + | + | + | + | + | + | + | + | un-assignable |
|  | 14304 | 4 | Yes | No | + | + | + | + | + | + | + | + | + |  |
|  | 14039 | 4 | Yes | No | + | + | + | + | + | + | + | + |  |  |
| 16A4 | 13876 | 5 | No | No | + | + | + | − | − | − | − | − | − | Unassigned complex epitope |
|  | 14071 | 5 | No | No | + | + | + | − | − | − | − | − | − |  |
| Rat anti-FLAG |  |  |  |  | + | + | + | + | + | + | + | + | + |  |

Legend Table 3

Human and/or murine chimera constructs

A = huCDH19(44-772) (see SEQ ID NO: 944)

B = huCDH19(44-141)::muCDH19(140-770) (see SEQ ID NO: 952)

C = huCDH19(44-249)::muCDH19(248-770) (see SEQ ID NO: 954)

D = muCDH19(44-139)::huCDH19(142-249)::muCDH19(248-770) (see SEQ ID NO: 956)

E = muCDH19(44-139)::huCDH19(142-364)::muCDH19(363-770) (see SEQ ID NO: 958)

F = muCDH19(44-247)::huCDH19(250-364)::muCDH19(363-770) (see SEQ ID NO: 960)

G = muCDH19(44-362)::huCDH19(365-772) (see SEQ ID NO: 962)

H = muCDH19(44-461)::huCDH19(464-772) (see SEQ ID NO: 964)

I = muCDH19(44-770) (see SEQ ID NO: 966)

Epitope Prediction by Human/Chicken Cadherin-19 Chimeras

Domain binding was determined by flow cytometry on 293T cells transiently transfected with plasmids consisting of single human CDH19 cadherin repeat domain replacements into the chicken Cadherin19 backbone cloned into the pTT5 expression vector immediately preceded by native human or chicken CDH19 leader sequences and a Flag tag. The experiment included assaying a subset of anti-CDH19 antibodies against chicken Cadherin19 to determine suitability for binning on these human/chicken chimeras.

The following binding assay was completed in presence of 2 mM CaCl2. In 96-well V-bottom plates (Costar 3897), 50,000 transiently transfected 293T cells were incubated with 5 ug/ml of purified anti-CDH19 antibodies for 1 hr at 4° C. followed by two washes with PBS/2% FBS. 50 µl of 5 µg/ml Alexa647-labelled anti-human IgG secondary antibody (Jackson Immuno 109-605-098) and 2 ug/ml 7AAD (Sigma A9400) was then added to each well and the plates incubated for 15 minutes at 4° C. Cells were then washed one time and the amount of cell associated Alexa647-labelled Ab was quantitated by flow cytometry. The experiments included mock transfected controls. The data from these experiments are presented in the Table below, n.d.=not determined.

TABLE 4

| | | | | | | | | | |
|---|---|---|---|---|---|---|---|---|---|
| Antibody Bin C Epitope Prediction Summary | | | | | | | | | |
| Clone ID | Ab. ID | Bin | Hu EC1-5 A | Ck EC1-5 J | Hu EC1 K | Hu EC2 L | Hu EC3 M | Hu EC5 O | Predicted Epitope Region |
| 4A9 | 13589 | 1 | + | − | + | − | − | − | 44-141 |
| 26F12 | 13881 | 2 | + | − | + | − | − | − | Bin A |
| 25F8 | 14096 | 2 | + | − | + | − | − | − | |
| 26D1 | 13882 | 2 | + | − | + | − | − | − | |
| 17H8 | 13874 | 3 | + | − | + | − | − | − | |
| 16A4 | 14071 | 5 | + | − | + | − | − | − | |
| 4A2 | 13592 | 4 | + | − | − | − | + | − | 250-364 |
| 4B10 | 13590 | 4 | + | − | − | − | + | − | Bin B |
| 2G6 | 13588 | 4 | + | − | − | − | + | − | |
| 23A10 | 14077 | 4 | + | − | − | − | + | − | |
| Rat anti-FLAG | | | + | + | + | + | + | + | control |

Positive Binding (+)

Negative Binding (−)

Legend Table 4

Human and/or chicken chimera constructs

A = huCDH19(44-772) (see SEQ ID NO: 944)

J = ckCDH19(44-776) (see SEQ ID NO: 970)

K = huCDH19(44-141)::ckCDH19(142-776) (see SEQ ID NO: 971)

L = ckCDH19(44-141)::huCDH19(142-249)::ckCDH19(250-776) (see SEQ ID NO: 972)

M = ckCDH19(44-249)::huCDH19(250-364)::ckCDH19(365-776) (see SEQ ID NO: 973)

N = ckCDH19(44-364)::huCDH19(365-463)::ckCDH19(469-776) (see SEQ ID NO: 974)

O = ckCDH19(44-468)::huCDH19(464-772) (see SEQ ID NO: 975)

Epitope Prediction by Macaque/Dog or Rat/Macaque Cadherin-19 Chimeras

Domain binding was determined by flow cytometry on 293T cells transiently transfected with plasmids consisting of rhesus macaque CDH19 cadherin repeat domain 1 or segments domain 1 (designated EC1a, EC1b, EC1c) replacements into the dog Cadherin19 backbone, or rat CDH19 cadherin repeat domain 2 replacement into the rhesus Cadherin19 backbone cloned into the pTT5 expression vector immediately preceded by native rhesus or canine CDH19 leader sequences and a Flag tag. The experiment included assaying a subset of anti-CDH19 antibodies against dog, rat and macaque Cadherin19 to determine suitability for binning on these macaque/dog and rat/rhesus chimeras.

The following binding assay was completed in presence of 2 mM CaCl2. In 96-well V-bottom plates (Costar 3897), 50,000 transiently transfected 293T cells were incubated with 5 ug/ml of purified anti-CDH19 antibodies for 1 hr at 4° C. followed by two washes with PBS/2% FBS. 50 μl of 5 μg/ml Alexa647-labelled anti-human IgG secondary antibody (Jackson Immuno 109-605-098) and 2 ug/ml 7AAD (Sigma A9400) was then added to each well and the plates incubated for 15 minutes at 4° C. Cells were then washed one time and the amount of cell associated Alexa647-labelled Ab was quantitated by flow cytometry. The experiments included mock transfected controls. The data from these experiments are presented in the Table below, n.d.=not determined.

The data summarized in table 5 allowed for segregating the binder of Bin A 44-141 into the following subgroups:
Bin A.1 44-141
Bin A.2 44-141 (44-114)
Bin A.3 44-141 (44-65)

Epitope Prediction by Rat/Mouse or Human/Mouse Cadherin-19 Chimeras

Domain binding was determined by flow cytometry on 293T cells transiently transfected with plasmids consisting of rat CDH19 cadherin repeat domain 3 substitutions (designated EC3a, EC3b) or human CDH19 cadherin repeat domain 3 substitution (designated EC3c) into the mouse Cadherin19 backbone cloned into the pTT5 expression vector immediately preceded by native mouse CDH19 leader sequence and a Flag tag. The experiment included assaying a subset of anti-CDH19 antibodies against human, rat and mouse Cadherin19 to determine suitability for binning on these rat/mouse and human/mouse chimeras.

The following binding assay was completed in presence of 2 mM CaCl2. In 96-well V-bottom plates (Costar 3897), 50,000 transiently transfected 293T cells were incubated with 5 ug/ml of purified anti-CDH19 antibodies for 1 hr at 4° C. followed by two washes with PBS/2% FBS. 50 μl of 5 μg/ml Alexa647-labelled anti-human IgG secondary antibody (Jackson Immuno 109-605-098) and 2 ug/ml 7AAD (Sigma A9400) was then added to each well and the plates incubated for 15 minutes at 4° C. Cells were then washed one time and the amount of cell associated Alexa647-

TABLE 5

Antibody BinA Epitope prediction Summary

| Clone ID | Ab. ID | Bin | Rh EC1-5 P | Ca EC1-5 Q | rh EC1 R | rh EC1a S | rh EC1b T | ra EC2 V | Ra EC1-5 W | Predicted Epitope Region |
|---|---|---|---|---|---|---|---|---|---|---|
| 4A9 | 13589 | 1 | + | − | + | − | − | − | − | 44-141 Bin A.1 |
| 26F12 | 13881 | 2 | + | − | + | + | + | − | − | 44-141 |
| 25F8 | 14096 | 2 | + | − | + | + | + | − | − | Bin A.2 |
| 26D1 | 13882 | 2 | + | − | + | + | + | − | − | (44-114) |
| 17H8 | 13874 | 3 | + | − | + | + | − | − | − | 44-141 |
| 16A4 | 14071 | 5 | + | − | + | + | − | n.d. | + | Bin A.3 (44-65) |
| 4A2 | 13592 | 4 | + | − | n.d. | n.d. | n.d. | n.d. | + | 250-364 |
| 4B10 | 13590 | 4 | + | + | n.d. | n.d. | n.d. | n.d. | + | Bin B |
| 2G6 | 13588 | 4 | + | + | n.d. | n.d. | n.d. | n.d. | + | |
| 23A10 | 14077 | 4 | + | + | n.d. | n.d. | n.d. | n.d. | + | |
| Rat anti-FLAG | | | + | + | + | + | + | + | + | |

Positive Binding (+)

Negative Binding (−)

Not Determined (n.d.)

Legend Table 5

Rhesus macaque, dog, and/or rat chimera constructs

P = rhCDH19(44-772) (see SEQ ID NO: 976)

Q = caCDH19(44-770) (see SEQ ID NO: 977)

R = rhCDH19(44-141)::caCDH19(141-770) (see SEQ ID NO: 978)

S = rhCDH19(44-65)::caCDH19(65-770) (see SEQ ID NO: 979)

T = caCDH19(44-87)::rhCDH19(89-114)::caCDH19(115-770) (see SEQ ID NO: 980)

U = caCDH19(44-120)::rhCDH19(122-137)::caCDH19(137-770) (see SEQ ID NO: 981)

V = rhCDH19(44-141)::raCDH19(140-247)::rhCDH19(250-772) (see SEQ ID NO: 982)

W = raCDH19(44-770) (see SEQ ID NO: 983)

labelled Ab was quantitated by flow cytometry. The experiments included mock transfected controls. The data from these experiments are presented in the Table below, n.d.=not determined.

TABLE 6

Antibody Bin B Epitope Prediction Summary

| Clone ID | Ab. ID | Bin | Hu EC1-5 A | Mo EC1-5 I | Ra EC1-5 W | Ra EC3c X | Ra EC3b Y | Hu EC3a Z | Predicted Epitope Region |
|---|---|---|---|---|---|---|---|---|---|
| 4A9 | 13589 | 1 | + | − | − | n.d. | n.d. | n.d. | 44-141 |
| 26F12 | 13881 | 2 | + | − | − | n.d. | n.d. | n.d. | Bin A |
| 25F8 | 14096 | 2 | + | − | − | n.d. | n.d. | n.d. | |
| 26D1 | 13882 | 2 | + | − | − | n.d. | n.d. | n.d. | |
| 17H8 | 13874 | 3 | + | − | − | n.d. | n.d. | n.d. | |
| 16A4 | 14071 | 5 | + | − | + | n.d. | n.d. | n.d. | |
| 4A2 | 13592 | 4 | + | − | + | + | − | − | 250-364 |
| 4B10 | 13590 | 4 | + | − | + | + | − | − | (324-327) Bin B.2 |
| 2G6 | 13588 | 4 | + | + | + | + | + | + | 250-364 |
| 23A10 | 14077 | 4 | + | + | + | n.d. | n.d. | n.d. | Bin B.1 |
| Rat anti-FLAG | | | + | + | + | + | + | + | control |

Positive Binding (+)
Negative Binding (−)
Not Determined (n.d.)
Legend Table 6
Rat/mouse or human/mouse chimera constructs
A = huCDH19(44-772) (see SEQ ID NO: 944)
I = muCDH19(44-770) (see SEQ ID NO: 966)
W = raCDH19(44-770) (see SEQ ID NO: 983)
X = muCDH19(44-323)::raCDH19(324-327)::muCDH19(328-770) (see SEQ ID NO: 984)
Y = muCDH19(44-770)::raCDH19(290, 299, 308) (see SEQ ID NO: 985)
Z = muCDH19(44-770)::huCDH19(271) (see SEQ ID NO: 986)

The data summarized in table 4 allowed for segregating the binder of Bin B 250-364 into the following subgroups:
Bin B.1 250-364
Bin B.2 250-364 (324-327) by rodent numeration as referenced in table 6, corresponding to residues (326-329) within human and macaque CDH19.

Example 4—Hotspot/Covariant Mutants

A total of 18 antibodies were analyzed for potential hotspots and covariance violations. The designed variants (shown below) outline amino acid substitutions capable of reducing and/or avoiding isomerization, deamidation, oxidation, covariance violations, and the like. The 80 engineered variants together with the 15 parental antibodies, thus totaling 95 sequences, were taken forward to the cloning, expression, and purification processes. Site-directed mutagenesis was performed on the engineered variants in a 96-well format. The parental antibodies and engineered variants were expressed by high throughput transient transfection in HEK 293-6E cells, purified using a modified AKTA auto-sampler and assayed for activity and biophysical characteristics. The 3 parental antibodies that had either free (unpaired) Cys or N-glycosylation site were not taken forward in this process. Those were replaced with the engineered version of the parental antibodies. The designed variants outline amino acid substitutions capable of reducing and/or avoiding isomerization, deamidation, oxidation, covariance violations, immunogenicity and the like. It will be appreciated that these variant sequences are examples of engineered antibodies within the meaning of the present application but single point and/or multiple point mutations can be combined in any combinatorial manner in order to arrive at a final desired antigen binding molecule or antibody.

Example 5—CDH19 mRNA Expression Pattern

Figure 3:
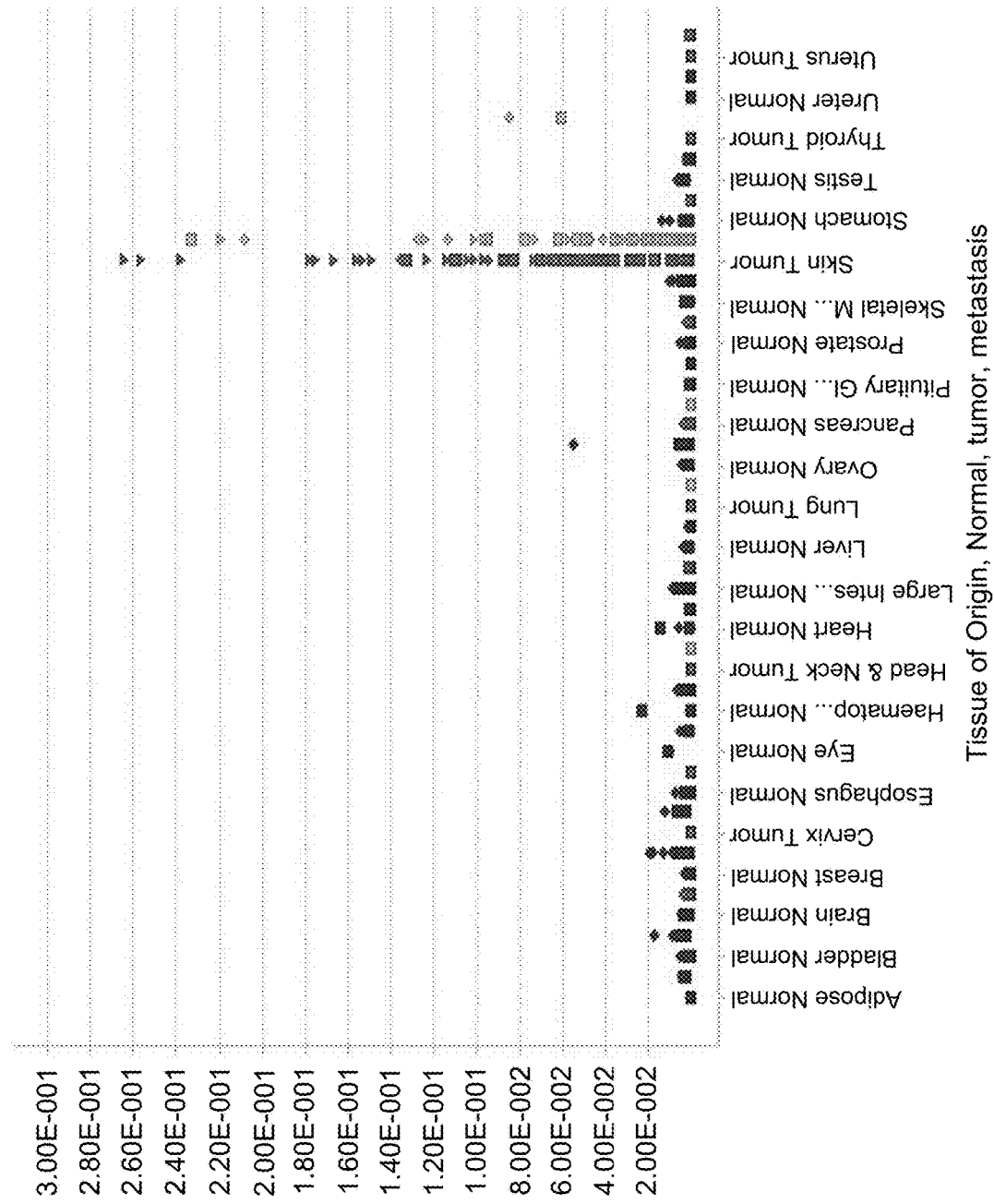
FIG. 3 shows the relative expression of CDH19 mRNA in metastatic and primary melanoma samples.

RNA was extracted from individual patient tissues representing tumor (>70% tumor content by cell count) or normal (0% tumor content by cell count). Individual tissues were homogenized using TisssueLyzer (Qiagen, Valencia, Calif.) and total RNA extracted and purified by the mirVana total RNA extraction kit (Life Technologies, Foster City, Calif.). RNA quality and quantity checked by NanoDrop (NanoDrop, Wilmington, Del.) spectrophotometer readings and Bioanalyzer RNA profiling (Agilient Technologies, Santa Clara, Calif.). RNA was DNAse treated with DNA-free kit (Life Technologies, Foster City, Calif.) and reverse transcribed according to manufacturer's specifications using random hexamers in the High Capacity cDNA Reverse Transcription Kit (Life Technologies, Foster City, Calif.). Quantitative Real Time Polymerase Chain Reaction (qRT-PCR) was performed on cDNA using primers to CDH19, probeset Hs00253534_m1, (Life Technologies, Foster City, Calif.) or the housekeeping gene human ACTB (primers CCT GGC ACC CAG CAC AA; GCC GAT CCA CAC GGA GTA CT; probe ATC AAG ATC ATT GCT CCT CCT GAG CG). 10 µL qRT-PCR reaction components; 1.0 ng/µL cDNA, 2× Universal PCR Master Mix (Life Technologies, Foster City, Calif.), gene expression assay (ACTB; 75 nM primers, 150 nM probe. EPOR; 300 nM primers, 250 nM probe) Following the qRT-PCR amplification program: (1) activation at 50° C. for 2 min; (2) denaturation at 95° C. for 10 min; (3) amplification 40 cycles at 95° C. for 15 s and 60° C. for 1 min with fluorescence capture at each step (ABI PRISM 7900HT Sequence Detection Systems, Applied Biosystems). Threshold cycle values ($C_T$) were determined, using Sequence Detector software version 2.3 (Applied Biosystems) and transformed to $2^{-\Delta CT}$ for relative expression of CDH19 specific transcript to ACTB. The results are shown in FIG. 3. Of 54 unique metastatic and primary melanoma samples, the majority can be seen to overexpress CDH19 mRNA relative to the expression in samples from normal tissue.

Example 6—CDH19 Protein Expression

Figure 4:
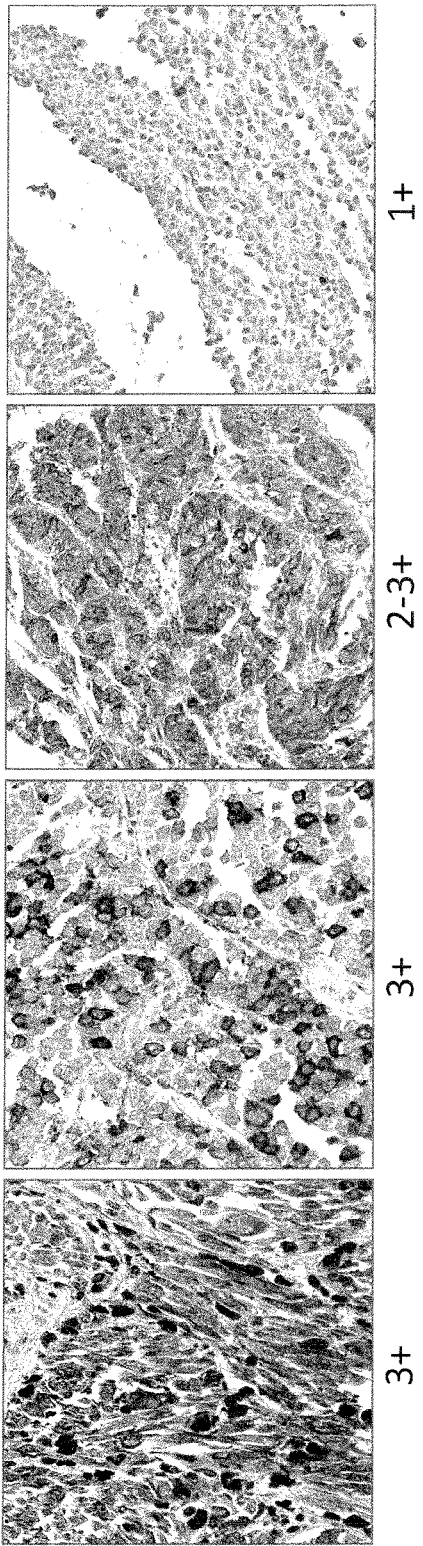
FIG. 4 shows the expression of CDH19 protein in human tumor samples by IHC.

Expression of CDH19 protein was analyzed in human tumor samples by IHC and the results are shown in FIG. 4. Samples were fixed in 10% neutral buffered formalin for 24 hours, dehydrated and paraffin embedded. 4 μm sections were cut. Sections were deparaffinized first and then heated in DIVA Decloaker solution (Biocare) for 40 minutes for antigen retrieval. Remaining IHC steps were performed at room temperature in a DAKO Autostainer. Sections were incubated for 10 minutes with Peroxidazed 1 (Biocare) to block endogenous peroxidase, followed by incubation for 10 minutes with background sniper (Biocare) to reduce non-specific background. Section were incubated for 60 minutes with CDH19 antibody (Novo Biologicals, Catalog #H00028513-B01P) at 5 μg/ml, then incubated for 30 minutes with Envision+HRP anti-mouse polymer (DAKO), followed by DAB+(DAKO) for 5 minutes. Sections were counterstained with hematoxylin (DAKO) approximately for 1 minute. CDH19 expression could be detected in 62% of tumors examined (staining intensity 1+ in 101 of 162 samples). 51% of the tumor samples demonstrated medium to high expression (staining intensity of 2+ to 3+ in 83 of 162 samples). CDH19 showed dense and distinct membrane staining in many samples, although in some tumors heterogeneity was noted.

Example 7—Selection of Model Cell Lines

Figure 5:
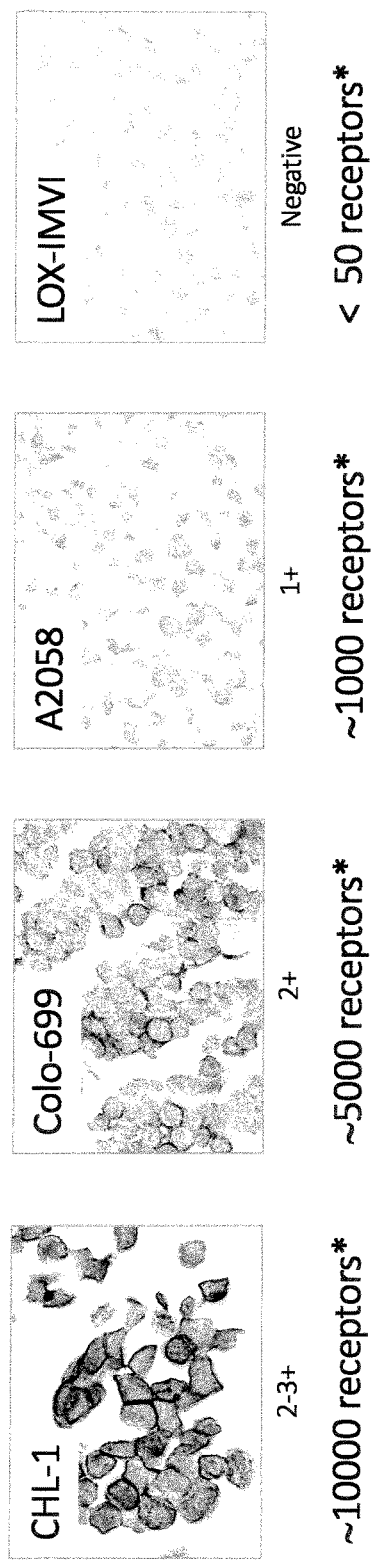
FIG. 5 shows the results of the analysis of tumor cell lines by flow cytometry and IHC to identify model systems with CDH19 expression similar to human tumors based on the number of CDH19 receptors present on the cell surface.

Tumor cell lines were analyzed by flow cytometry and IHC to identify model systems with CDH19 expression similar to human tumors. Human anti-huCDH19 IgG4 antibody 4A2 was purified directly from hybridoma conditioned media. For flow cytometry, $2 \times 10^5$ cells were incubated with 200 nM of the CDH19 4A2 antibody that was conjugated to PE at a 1:1 ratio. The incubation and subsequent wash steps were performed in the presence of 1.2 mM calcium. A tube of QuantiBRITE PE lyophilized beads with four levels of PE (BD, cat#340495) was simultaneously prepared according to the manufacturer's instructions. The beads were analyzed by flow cytometry to generate a standard curve. The PE median values obtained from the melanoma lines after FACS analysis were then calibrated against the standard curve to calculate the antibodies bound per cell (ABC), which provides an estimate of the number of receptors on each cell. IHC was performed as described in Example 6 and the results are provided in FIG. 5. The melanoma cell line CHL-1 expresses about 10,000 CDH19 molecules on the cell surface, while Colo699 cells express about 5,000 receptors. Both cell lines represent tumors with medium to high expression levels based on IHC. Expression in A2058 is very low, while LOX cells do not express any detectable CDH19 protein.

Example 8—Preparation of Antibody Drug Conjugates

DNA sequences encoding the heavy chain and light chain components of anti-CDH19 antibodies were subcloned into mammalian expression vector pTT5 and transiently co-transfected into 293-6E cells, as described in published US2005/0170450 which is incorporated in its entirety by reference. Antibodies were purified from conditioned media by protein A affinity and ion exchange chromatography. Antibodies were incubated at 3 to 5 mg/ml with 4 to 13 equivalents of SMCC-DM1 in neutral to slightly basic buffered solutions containing 50 mM sodium chloride, 2 mM EDTA, and from 5 to 15% dimethylacetamide at room temperature for up to 5 hours or at 4° C. for up to 18 hours. Conjugation to DM1 and DAR determination for conjugates, is described in U.S. Pat. No. 7,368,565 and related U.S. Pat. No. 7,851,432, which are herein incorporated in their entirety by reference. Resultant antibody drug conjugates (ADCs) were purified from solutes and unconjugated drug by gel permeation or ion exchange chromatography. UV spectrophotometric measurements at 252 nm and 280 nm combined with respective molar extinction coefficients of SMCC-DM1 and antibody as defined by amino acid composition were used to algebraically determine the concentration of drug (CD) and antibody (CAb) components of ADC preparations which could be used to calculate a drug to antibody ratio (DAR) as described in U.S. Pat. No. 7,368,565. DAR determinations of ADCs were more accurately made by similar algebraic calculations based on integrated peaks measured at 252 nm and 280 nm in analytical size exclusion chromatography. Orthogonal LC/MS methods were also used to qualitatively assess random drug distribution profiles by mass. The table below describes ADCs used in the experiments for which the results are provided in FIG. 6 (lots 1,2), FIG. 7 (lots 3-10), and FIG. 8 (lots 11-14), which are representative of typical ADC preparations.

Figure 6:
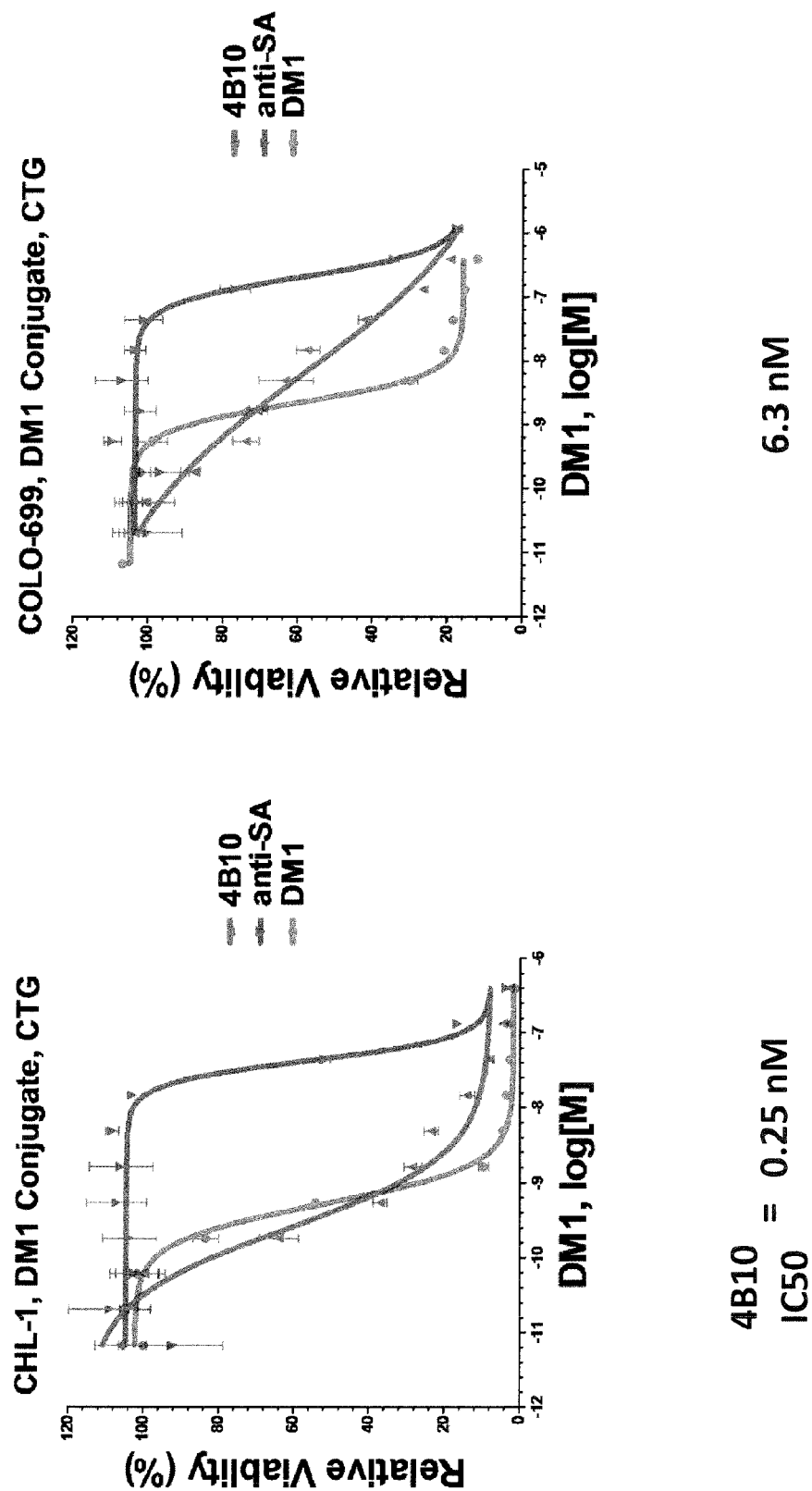
FIG. 6 shows in vitro activity of a CDH19 ADC against the model tumor cell lines.
Figure 6:
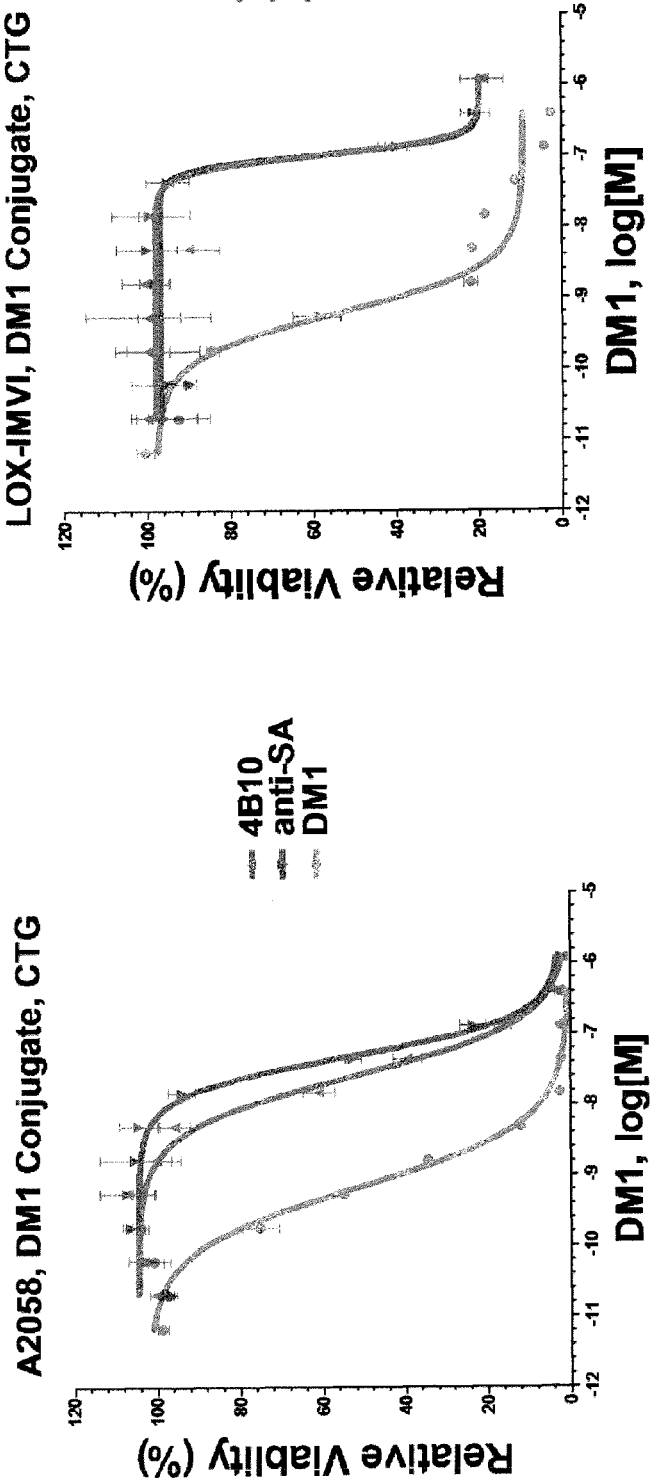
Figure 7:
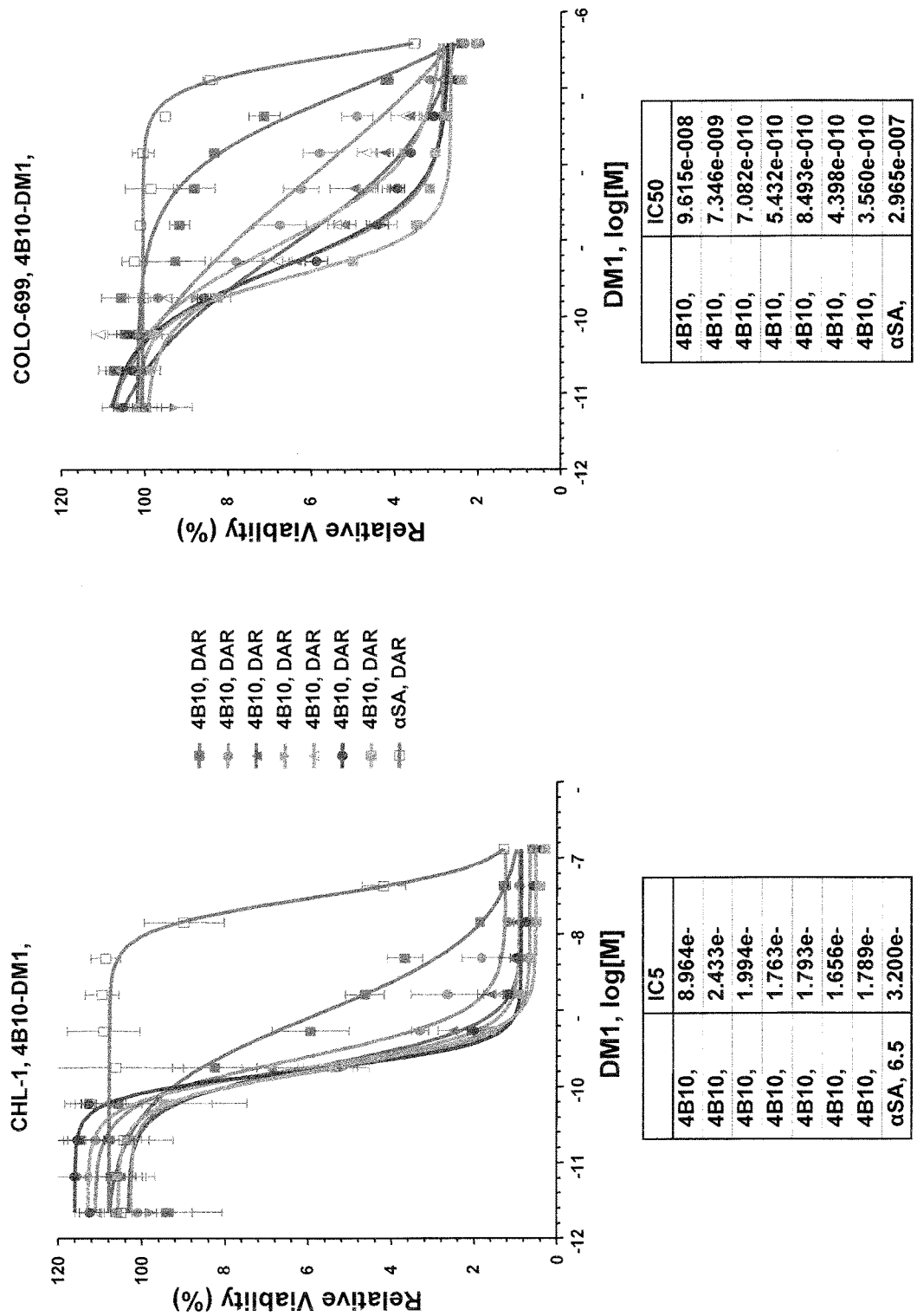
FIG. 7 shows in vitro activity of a CDH19 ADC in model tumor cell lines at varying DAR ratios.
Figure 8:
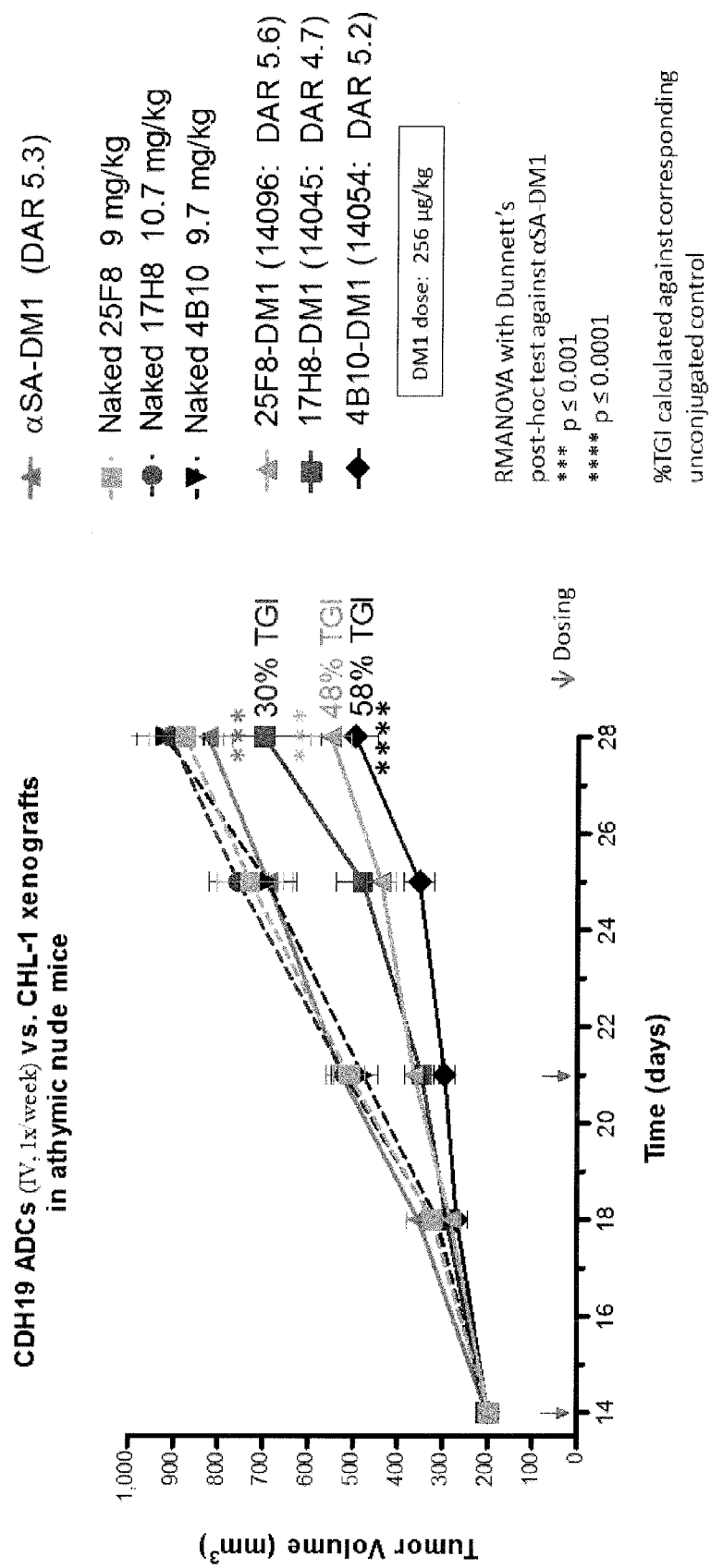
FIG. 8 shows in vivo activity of CDH19 ADCs in a xenograft mouse model as compared to naked CDH19 antibodies.

| Example | ADC lot | ID | hu anti-huCDH19 IgG1 antibody | DAR |
|---|---|---|---|---|
| FIG. 6 | 1 | 13590 | 4B10 | 3.6 |
| FIG. 6 | 2 | 1462 | anti-SA (anti-streptavidin control) | 4.5 |
| FIG. 7 | 3 | 13590 | 4B10 | 2.5 |
| FIG. 7 | 4 | 13590 | 4B10 | 4.1 |
| FIG. 7 | 5 | 13590 | 4B10 | 5.1 |
| FIG. 7 | 6 | 13590 | 4B10 | 5.8 |
| FIG. 7 | 7 | 13590 | 4B10 | 5 |
| FIG. 7 | 8 | 13590 | 4B10 | 6.3 |
| FIG. 7 | 9 | 13590 | 4B10 | 7.4 |
| FIG. 7 | 10 | 1462 | anti-SA (anti-streptavidin control) | 6.5 |
| FIG. 8 | 11 | 14096 | 25F8.1 (K45Q, S102A, D111E) VL + (F90Y) VH | 5.6 |
| FIG. 8 | 12 | 14045 | 17H8.2 (G149R) VL | 4.7 |
| FIG. 8 | 13 | 14054 | 4B10 (H45Q, A90T) VL + (R17G) VH | 5.2 |
| FIG. 8 | 14 | 1462 | anti-SA (anti-streptavidin control) | 5.3 |

Example 9—Activity of CDH19 Targeting ADCs in Model Cell Lines

The CDH19 recognizing parental antibody 4B10 (Ab ID 13590) was covalently coupled to the toxin DM1 as described in Example 8. The tumor cells were plated in 384-well microtiter plates on Day 1, and on Day 2, the ADC was titrated on the cells and incubated for additional 72 h. Cell viability was determined at the end of the experiment with CellTiterGlo reagent (Promega) according to the manufacturer's instructions. Unconjugated, free DM1 served as a positive control, and a streptavidin recognizing antibody/DM1 conjugate served as a negative control to detect non specific binding. IC50s were determined with a non-linear, 4 parameter curve fit and are shown in FIG. 6.

Example 10—Effect of Drug to Antibody Ratio (DAR) on ADC Potency

In order to assess the effect of the drug antibody ratio on the potency of the ADC molecule, the CDH19 recognizing parental antibody 4B10 (Ab ID 13590) was coupled with different amounts of DM1 as indicated in FIG. 7. The effect of DARs on ADC potency was determined in cell viability assays as described in Example 9. An increased DAR leads to increases in potency for a given DM1 concentration. This effect is more pronounced on tumor cells with lower CDH19 expression.

Example 11—Efficacy of CDH19 Targeting ADCs In Vivo

Three CDH19 recognizing engineered variant antibodies (Ab IDs 14096, 14045, 14054) were coupled to DM1 and tested in xenograft experiments. CHL-1 cells were suspended in a solution of 50% serum free medium and 50% Matrigel, and implanted subcutaneously in the flank of female athymic nude mice. Each mouse received five million cells in a volume of 200 µl. When tumors reached approximately 200 mm$^3$, mice were sorted into seven groups of 10 mice each with equivalent mean and SD tumor size per group, and dosed with test agents or controls. All treatments were administered IV in a volume of 200 µl. Tumors were measured two times per week using calipers. Length, width and height measurements were taken A repeated measures ANOVA with Dunnett's post-hoc test was used to compare the difference in tumor volume between each CDH19 targeting ADC and a non-specific control ADC (anti-streptavidin coupled to DM1). The percentage of tumor growth inhibition was calculated for each CDH19 targeting ADC compared to the corresponding unconjugated antibody. All three reagents demonstrate significant inhibition of tumor growth in mice as shown in FIG. 8.

Example 12—Internalization of CDH19 Following ADC Binding

Human anti-huCDH19 IgG4 antibody 4A2 was purified directly from hybridoma conditioned media and conjugated with SMCC-DM1 as described in example 8. Because the exact sequence of parental 4A2 was unknown at the time, the DAR of this IgG4 ADC was estimated to be 4.4 using a molecular weight of 150,000 Da and an extinction coefficient of 225,000 at 280 nm. CHL-1 melanoma cells were incubated with either unconjugated or DM1 conjugated CDH19 recognizing parental antibody 4A2 in complete medium at 4° C. or for 2 h at 37° C. After a brief wash in PBS, cells were fixed in 3% formaldehyde/PBS for 20 min. Fixed cells were washed, blocked and permeabilized in TBST/1% BSA/5% normal donkey serum/0.3% TX-100 and incubated with rabbit anti-EEA1 (CST #3288). Following another wash step, the samples were incubated with donkey anti mouse Alexa 488 and donkey anti rabbit Alexa 554. Images were taken with a 63× oil lens on a Zeiss LSM 510 confocal microscope. A review of the images demonstrate that both the parental and DM1 conjugated antibody detect the membrane bound CDH19 at 4° C. but get quickly internalized and co-localize with endosome markers at 37° C. Thus, both the unconjugated and DM1 conjugated CDH19 antibodies are internalized by melanoma cells, and the conjugation of the drug does not appear to interfere with the internalization of the CDH19 antibody.

Figure 9:
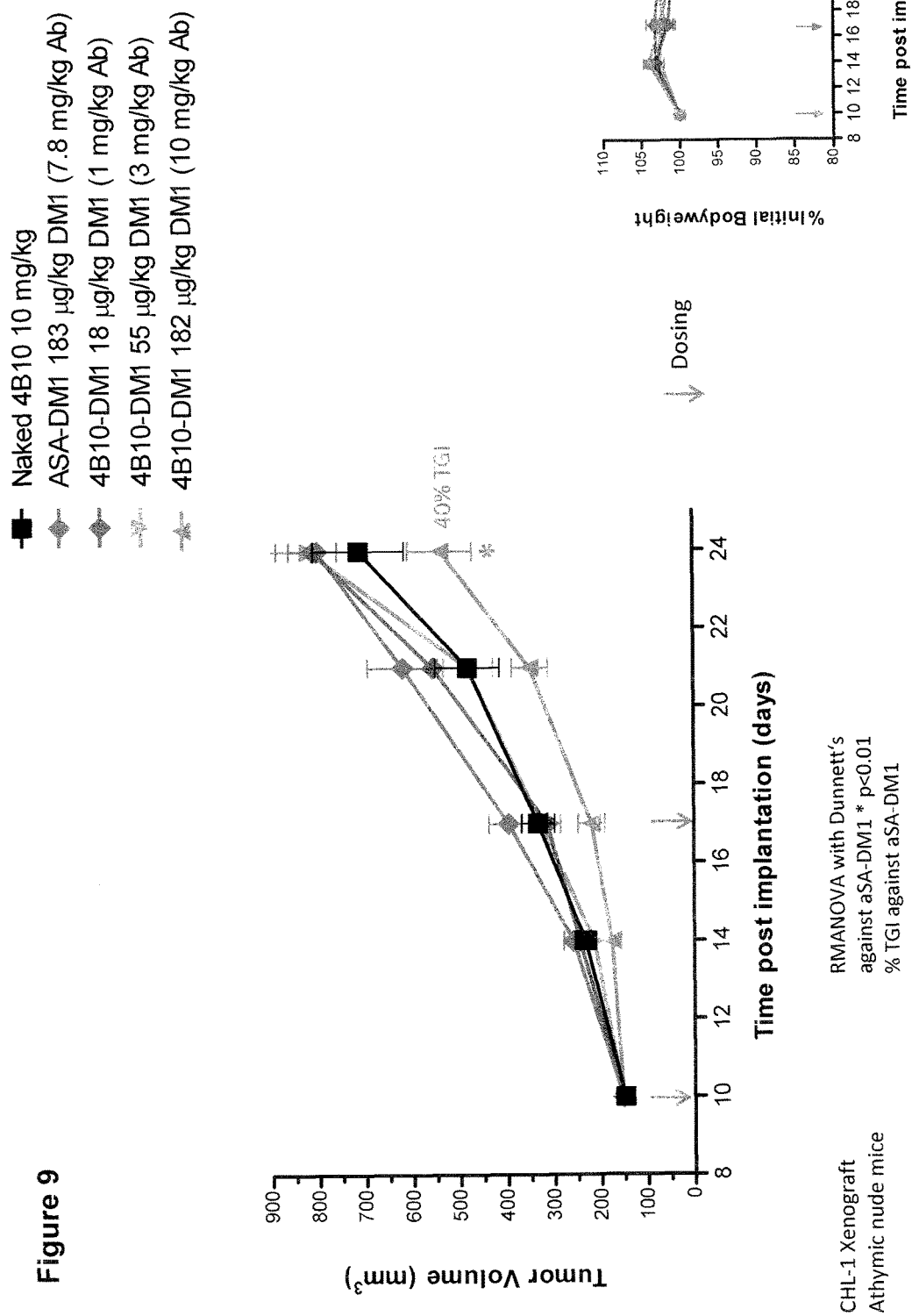
FIG. 9 shows in vivo activity of CDH19 ADCs in a xenograft mouse model. 4B10-DM1 Moderately Inhibited Tumor Growth at 182 μg/kg DM1 in CHL-1 Xenografts

Example 13—Efficacy of CDH19 Targeting ADCs In Vivo 13.1: 4B10-DM1 Moderately Inhibited Tumor Growth at 182 µg/Kg DM1 in CHL-1 Xenografts A study was conducted to examine the effect of the anti-CDH19 ADC 4B10-DM1 administered once per week for two weeks in CHL-1 xenografts. CHL-1 cells were suspended in a solution of 50% serum free medium and 50% Matrigel, and implanted subcutaneously in the flank of female athymic nude mice. Each mouse received five million cells in a volume of 200 µl. When tumors reached approximately 150 mm3, mice were sorted into groups of 10 mice each with equivalent mean and SD tumor size per group and dosed with test agents or controls. All treatments were administered IV in a volume of 200 µl. Tumors were measured two times per week using calipers (length, width and height measurement). Body weights were recorded at each measurement. A repeated measures ANOVA with Dunnett's post-hoc test was used to compare the difference in tumor volume between mice treated with 4B10-DM1 and the ADC control. The percentage of tumor growth inhibition was calculated against the ADC control. The results are shown in FIG. 9.

Figure 10:
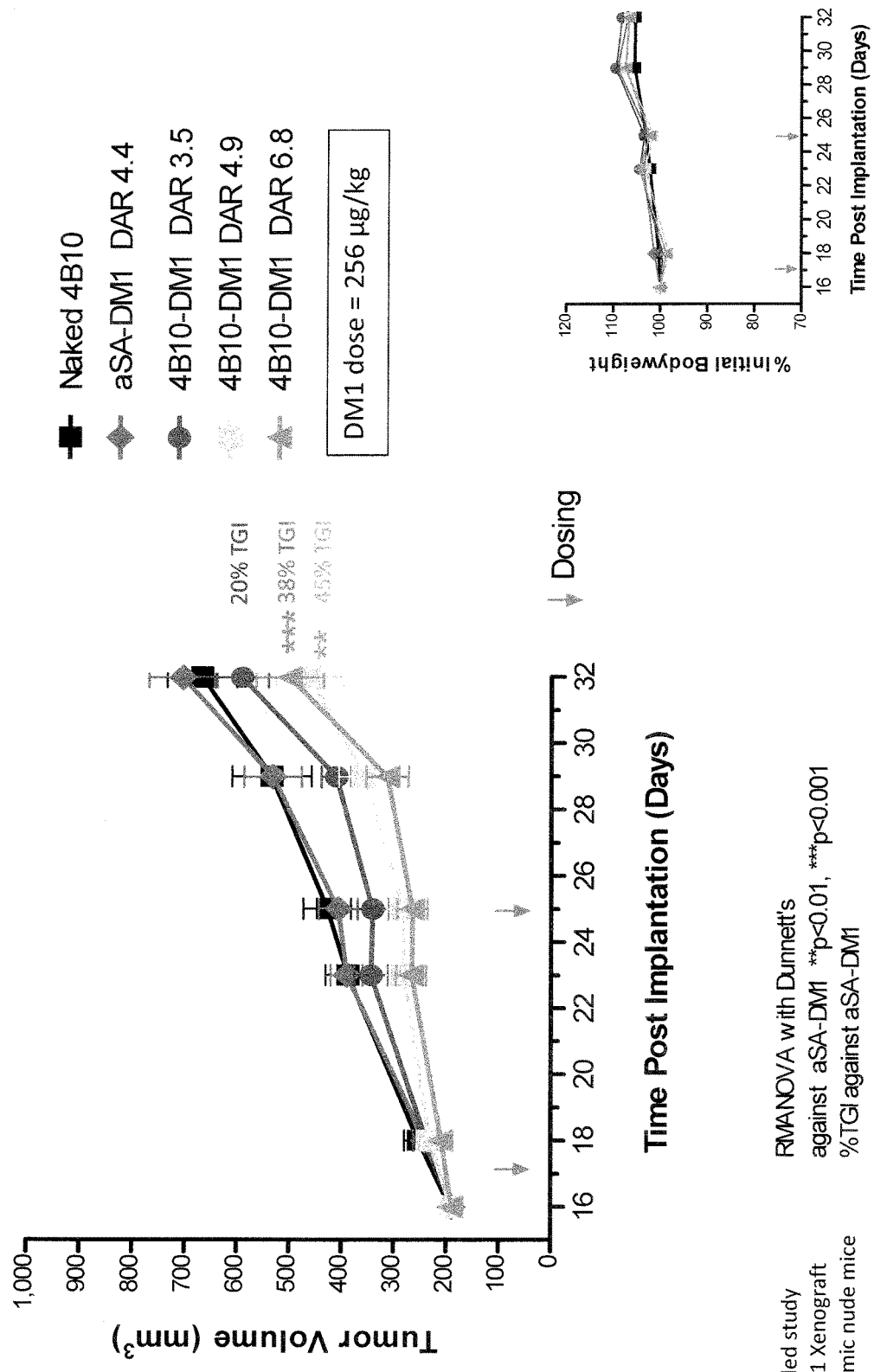
FIG. 10 shows in vivo activity of CDH19 ADCs in a xenograft mouse model. Increasing the DAR Did Not Increase Tumor Growth Inhibition in CHL-1 Xenografts

13.2: Increasing the DAR Did not Increase Tumor Growth Inhibition in CHL-1 Xenografts A study was conducted to examine the effect of drug: antibody ratio (DAR) on efficacy of the anti-CDH19 ADC 4B10-DM1 administered once per week for two weeks in CHL-1 xenografts. CHL-1 cells were suspended in a solution of 50% serum free medium and 50% Matrigel, and implanted subcutaneously in the flank of female athymic nude mice. Each mouse received five million cells in a volume of 200 µl. When tumors reached approximately 200 mm3, mice were sorted into groups of 10 mice each with equivalent mean and SD tumor size per group and dosed with test agents or controls. All treatments were administered IV in a volume of 200 µl. Tumors were measured two times per week using calipers (length, width and height measurement). Body weights were recorded at each measurement. A repeated measures ANOVA with Dunnett's post-hoc test was used to compare the difference in tumor volume between mice treated with 4B10-DM1 and the ADC control. The percentage of tumor growth inhibition was calculated against the ADC control. The results are shown in FIG. 10.

13.3: Anti-CDH19 ADCs Moderately Inhibited Tumor Growth in COL0699 Xenografts

Figure 11:
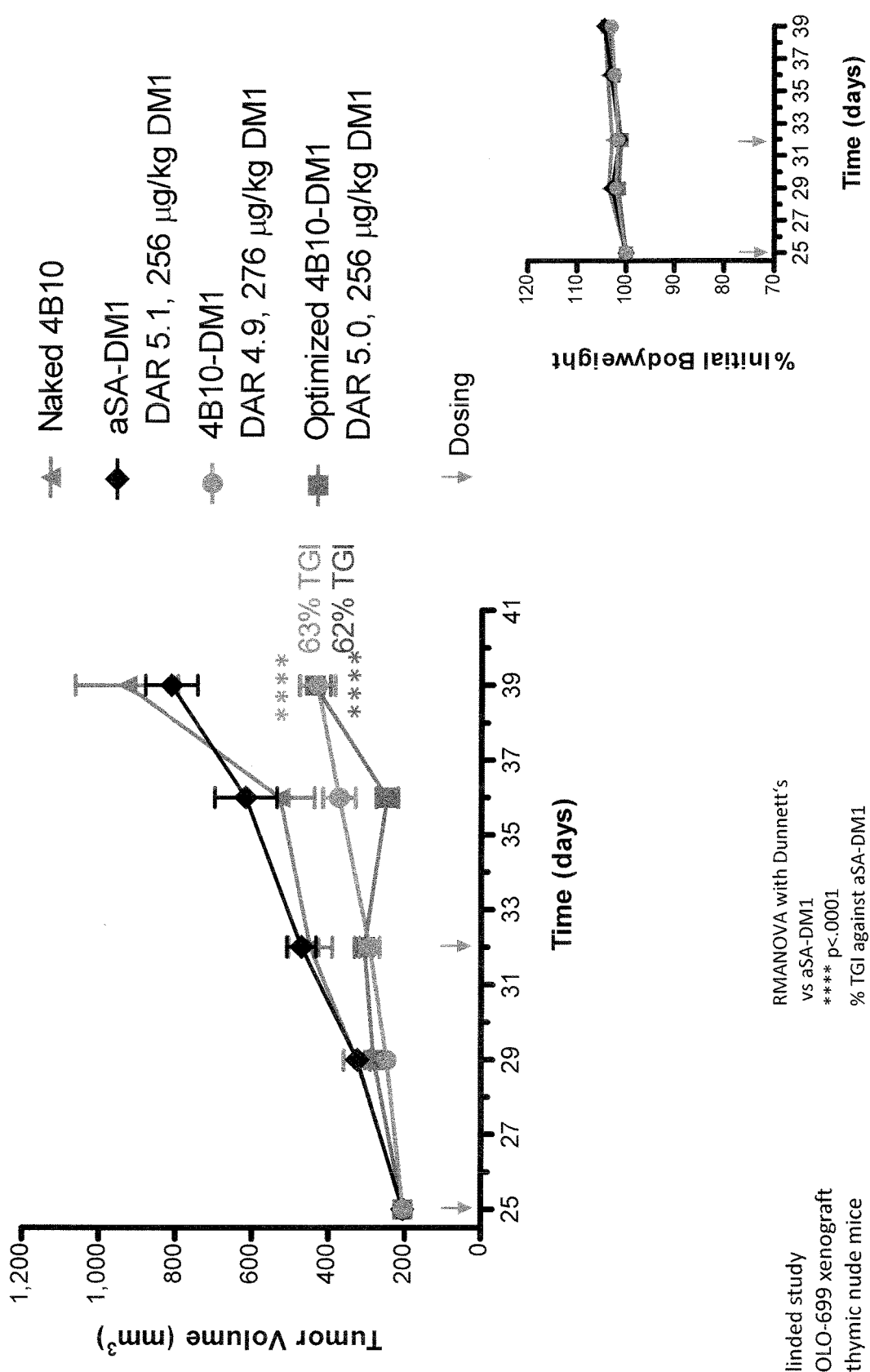
FIG. 11 shows in vivo activity of CDH19 ADCs in a xenograft mouse model. Anti-CDH19 ADCs Moderately Inhibited Tumor Growth in COL0699 Xenografts

A study was conducted to examine the effects of anti-CDH19 ADC 4B10-DM1 and an optimized variant administered once per week for two weeks on COL0699 xenografts. COL0699 cells were suspended in a solution of 50% serum free medium and 50% Matrigel, and implanted subcutaneously in the flank of female athymic nude mice. Each mouse received five million cells in a volume of 200 µl. When tumors reached approximately 200 mm3, mice were sorted into groups of 10 mice each with equivalent mean and SD tumor size per group, and dosed with test agents or controls. All treatments were administered IV in a volume of 200 µl. Tumors were measured two times per week using calipers (length, width and height measurement). Body weights were recorded at each measurement. A repeated measures ANOVA with Dunnett's post-hoc test was used to compare the difference in tumor volume between mice treated with 4B10-DM1 and the ADC control. The percentage of tumor growth inhibition was calculated against the ADC control. A similar study was conducted as described above (data not shown) that resulted in the same trends for tumor growth inhibition, however, that study did not reach statistical significance. The results are shown in FIG. 11.

Sequence Table

TABLE I

| Ab | Type | CDR 1 | CDR 2 | CDR 3 |
|---|---|---|---|---|
| | a: HEAVY CHAIN CDRs | | | |
| 1D10 2C12 | NA | AGCTATGGCATGCAC | GTTATATGGTATGATGGAAGT AATAAATACTATGCAGACTCC GTGAAGGGC | AGGGCCGGTATAATAGGAAC TACAGGCTACTACTACGGTA TGGACGTC |
| | | SEQ ID NO: 1 | SEQ ID NO: 2 | SEQ ID NO: 3 |
| | AA | SYGMH | VIWYDGSNKYYADSVKG | RAGIIGTTGYYYGMDV |
| | | SEQ ID NO: 4 | SEQ ID NO: 5 | SEQ ID NO: 6 |
| 1F10 | NA | AGTGGTGGTTACTACT GGAGC | TACATCTATTACAGTGGGAGC ACCTACTACAACCCGTCCCTC ACGAGT | GATGGAAGCAGTGGCTGGTA CTTCCAGCAC |
| | | SEQ ID NO: 7 | SEQ ID NO: 8 | SEQ ID NO: 9 |
| | AA | SGGYYWS | YIYYSGSTYYNPSLTS | DGSSGWYFQH |
| | | SEQ ID NO: 10 | SEQ ID NO: 11 | SEQ ID NO: 12 |
| 2C12_LC#1 | NA | AGCTATGGCATGCAC | GTTATATGGTATGATGGAAGT AATAAATACTATGCAGACTCC GTGAAGGGC | AGGGCCGGTATAATAGGAAC TACAGGCTACTACTACGGTA TGGACGTC |
| | | SEQ ID NO: 13 | SEQ ID NO: 14 | SEQ ID NO: 15 |
| | AA | SYGMH | VIWYDGSNKYYADSVKG | RAGIIGTTGYYYGMDV |
| | | SEQ ID NO: 16 | SEQ ID NO: 17 | SEQ ID NO: 18 |
| 2G6_LC#1 | NA | AGCTATGGCATGCAC | TTTATATGGTATGATGGAAGT AATAAATACTATGCAGACTCC GTGAAGGAC | AGGGCCGGTATAATAGGAAC TATAGGCTACTACTACGGTA TGGACGTC |
| | | SEQ ID NO: 19 | SEQ ID NO: 20 | SEQ ID NO: 21 |
| | AA | SYGMH | FIWYDGSNKYYADSVKD | RAGIIGTIGYYYGMDV |
| | | SEQ ID NO: 22 | SEQ ID NO: 23 | SEQ ID NO: 24 |
| 2G6 | NA | AGCTATGGCATGCAC | TTTATATGGTATGATGGAAGT AATAAATACTATGCAGACTCC GTGAAGGAC | AGGGCCGGTATAATAGGAAC TATAGGCTACTACTACGGTA TGGACGTC |
| | | SEQ ID NO: 25 | SEQ ID NO: 26 | SEQ ID NO: 27 |
| | AA | SYGMH | FIWYDGSNKYYADSVKD | RAGIIGTIGYYYGMDV |
| | | SEQ ID NO: 28 | SEQ ID NO: 29 | SEQ ID NO: 30 |
| 2H12 | NA | AGCTATGGCATGCAC | GTTATATGGTATGATGGAAGT AATAAATACTATACAGACTCC GTGAAGGGC | AGGGCCGGTATAATAGGAAC TACAGGCTACTACTACGGTA TGGACGTC |
| | | SEQ ID NO: 31 | SEQ ID NO: 32 | SEQ ID NO: 33 |
| | AA | SYGMH | VIWYDGSNKYYTDSVKG | RAGIIGTTGYYYGMDV |
| | | SEQ ID NO: 34 | SEQ ID NO: 35 | SEQ ID NO: 36 |
| 2H12_LC#2 | NA | AGCTATGGCATGCAC | GTTATATGGTATGATGGAAGT AATAAATACTATACAGACTCC GTGAAGGGC | AGGGCCGGTATAATAGGAAC TACAGGCTACTACTACGGTA TGGACGTC |
| | | SEQ ID NO: 37 | SEQ ID NO: 38 | SEQ ID NO: 39 |
| | AA | SYGMH | VIWYDGSNKYYTDSVKG | RAGIIGTTGYYYGMDV |
| | | SEQ ID NO: 40 | SEQ ID NO: 41 | SEQ ID NO: 42 |
| 4A2 5B4 5C5 | NA | AGTAGTGGTTACTACT GGAGC | TACATCTATTACACTGGGAGC GCCTACTACAACCCGTCCCTC AAGAGT | GATGGAAGCAGTGGCTGGTA CTTCCAGTAT |
| | | SEQ ID NO: 43 | SEQ ID NO: 44 | SEQ ID NO: 45 |
| | AA | SSGYYWS | YIYYTGSAYYNPSLKS | DGSSGWYFQY |
| | | SEQ ID NO: 46 | SEQ ID NO: 47 | SEQ ID NO: 48 |
| 4A9 | NA | GGTTACTACTGGAGC | TATTTCTCTTACAGTGGGAGC ACCAACTACAACCCCTCCCTC AAGAGT | AACTGGGCCTTCCACTTTGA CTTC |
| | | SEQ ID NO: 49 | SEQ ID NO: 50 | SEQ ID NO: 51 |
| | AA | GYYWS | YFSYSGSTNYNPSLKS | NWAFHFDF |
| | | SEQ ID NO: 52 | SEQ ID NO: 53 | SEQ ID NO: 54 |
| 4B10 4C2 | NA | AGCTATGACATGCAC | GTTATATCATATGATGGAACT AATGAATACTATGCAGACTCC GTGAAGGGC | GAACGATATTTTGACTGGTC TTTTGACTAC |
| | | SEQ ID NO: 55 | SEQ ID NO: 56 | SEQ ID NO: 57 |
| | AA | SYDMH | VISYDGTNEYYADSVKG | ERYFDWSFDY |
| | | SEQ ID NO: 58 | SEQ ID NO: 59 | SEQ ID NO: 60 |

TABLE I-continued

| Ab | Type | CDR 1 | CDR 2 | CDR 3 |
|---|---|---|---|---|
| 4D2 | NA | AGTTATGACATGCAC | GTTATATCATATGATGGAACTAATGAATACTATGCAGACTCCGTGAAGGGC | GAACGATATTTTGACTGGTCTTTTGACTAC |
| | | SEQ ID NO: 61 | SEQ ID NO: 62 | SEQ ID NO: 63 |
| | AA | SYDMH | VISYDGTNEYYADSVKG | ERYFDWSFDY |
| | | SEQ ID NO: 64 | SEQ ID NO: 65 | SEQ ID NO: 66 |
| 4D3 4F3 | NA | AGCTATGACATGGAC | GTTATATGGTATGATGGAAGTAATAAAtacTATGCAGACTCCGTGAGGGGC | GAAACTGGGGAGGgCTGGTACTTCGAtctc |
| | | SEQ ID NO: 67 | SEQ ID NO: 68 | SEQ ID NO: 69 |
| | AA | SYDMD | VIWYDGSNKYYADSVRG | ETGEGWYFDL |
| | | SEQ ID NO: 70 | SEQ ID NO: 71 | SEQ ID NO: 72 |
| 4E10 | NA | AGCTATGACATGCAC | GTTATATGGTATGATGGAAGTAATAAATACTATGCAGACTCCGTGAAGGGC | GAGTATAGGTACAGCTGGTACTTTGACTAC |
| | | SEQ ID NO: 73 | SEQ ID NO: 74 | SEQ ID NO: 75 |
| | AA | SYDMH | VIWYDGSNKYYADSVKG | EYRYSWYFDY |
| | | SEQ ID NO: 76 | SEQ ID NO: 77 | SEQ ID NO: 78 |
| 4F7 | NA | AGTTACTCCTGGAGC | TATATCTATTACAGTGGGAGCACCAACTACAACCCCTCCCTCAAGAGT | AACTGGGCCTTCCACTTTGACTAC |
| | | SEQ ID NO: 79 | SEQ ID NO: 80 | SEQ ID NO: 81 |
| | AA | SYSWS | YIYYSGSTNYNPSLKS | NWAFHFDY |
| | | SEQ ID NO: 82 | SEQ ID NO: 83 | SEQ ID NO: 84 |
| 5E3 | NA | AGCTATAGCATGCAC | TCCATTAGTAGTAGTAGTAGTTACATATACTACGCAGACTCAGTGAAGGGC | GGGGAAACTGGAACTAACTACTACTACGGTATGGACGTC |
| | | SEQ ID NO: 85 | SEQ ID NO: 86 | SEQ ID NO: 87 |
| | AA | SYSMH | SISSSSSYIYYADSVKG | GETGTNYYYYGMDV |
| | | SEQ ID NO: 88 | SEQ ID NO: 89 | SEQ ID NO: 90 |
| 17H8 23B6 28D10 | NA | AGTTACTACTGGAGC | TATATCTATTACATTGGGAGCACCAACTACAACCCCTCCCTCAAGAGT | GATTCCCGGTATAGAAGTGGCTGGTACGATGCTTTTGATATC |
| | | SEQ ID NO: 91 | SEQ ID NO: 92 | SEQ ID NO: 93 |
| | AA | SYYWS | YIYYIGSTNYNPSLKS | DSRYRSGWYDAFDI |
| | | SEQ ID NO: 94 | SEQ ID NO: 95 | SEQ ID NO: 96 |
| 16C1 | NA | GGTTACTACTGGAGC | TATATCTATTACATTGGGAGCACCAACTACAACCCCTCCCTCAAGAGT | GATGGGAGCAGTGGCTGGTACCGGGTGGTTCGACCCC |
| | | SEQ ID NO: 97 | SEQ ID NO: 98 | SEQ ID NO: 99 |
| | AA | GYYWS | YIYYIGSTNYNPSLKS | DGSSGWYRWFDP |
| | | SEQ ID NO: 100 | SEQ ID NO: 101 | SEQ ID NO: 102 |
| 16A4 | NA | AGTTACTACTGGAGC | TATATCTATTACAGTGGGAGCACCAATTACAACCCCTCCCTCAAGAGT | GATCAAAGGCGGATAGCAGCAGCTGGTACCCACTTCTACGGTATGGACGTC |
| | | SEQ ID NO: 103 | SEQ ID NO: 104 | SEQ ID NO: 105 |
| | AA | SYYWS | YIYYSGSTNYNPSLKS | DQRRIAAAGTHFYGMDV |
| | | SEQ ID NO: 106 | SEQ ID NO: 107 | SEQ ID NO: 108 |
| 16E2 17E10 20B12 | NA | AGCTATGGCATGCAC | GTGATATGGTATGATGGAAGTAATAAATACTATGCAGACTCCGTGAAGGGC | GACGGGTGGGAGCTGTCCTTTGACTAC |
| | | SEQ ID NO: 109 | SEQ ID NO: 110 | SEQ ID NO: 111 |
| | AA | SYGMH | VIWYDGSNKYYADSVKG | DGWELSFDY |
| | | SEQ ID NO: 112 | SEQ ID NO: 113 | SEQ ID NO: 114 |
| 22G10 | NA | AGTTATGCCATGAAC | ACTATTAGTGGTGGTGGTGCTAACACATACTACGCAGACTCCGTGAAGGGC | GGGGGAATGGGGGGATACTACTACGGTATGGACGTC |
| | | SEQ ID NO: 115 | SEQ ID NO: 116 | SEQ ID NO: 117 |
| | AA | SYAMN | TISGGGANTYYADSVKG | GGMGGYYYGMDV |
| | | SEQ ID NO: 118 | SEQ ID NO: 119 | SEQ ID NO: 120 |
| 16H2 20D3 23E7 | NA | AGCTACTTTATTCAC | ATAATCAACCCTATTAGTGTTAGCACAAGCTACGCACAGAAGTTCCAGGGC | GGGGGGATACAGCTATGGTTACATTTTGACTAC |
| | | SEQ ID NO: 121 | SEQ ID NO: 122 | SEQ ID NO: 123 |
| | AA | SYFIH | IINPISVSTSYAQKFQG | GGIQLWLHFDY |
| | | SEQ ID NO: 124 | SEQ ID NO: 125 | SEQ ID NO: 126 |

TABLE I-continued

| Ab | Type | CDR 1 | CDR 2 | CDR 3 |
|---|---|---|---|---|
| 22D1 | NA | AGCTACTTTATTCAC | ATAATCAACCCTATTAGTGTT AGCACAAGCTACGCACAGAAG TTCCAGGGC | GGGGGGATACAGCTATGGTT ACATTTGGACTAC |
| | | SEQ ID NO: 127 | SEQ ID NO: 128 | SEQ ID NO: 129 |
| | AA | SYFIH | IINPISVSTSYAQKFQG | GGIQLWLHLDY |
| | | SEQ ID NO: 130 | SEQ ID NO: 131 | SEQ ID NO: 132 |
| 25F8 | NA | AGCTACTATATTCAC | ATAATCAACCCCAGTGGTGGT AGCACAAGGTACGCACAGAAG TTCCAGGGC | GGGGGAATACAGCTATGGTT ACATTttGACTAC |
| | | SEQ ID NO: 133 | SEQ ID NO: 134 | SEQ ID NO: 135 |
| | AA | SYYIH | IINPSGGSTRYAQKFQG | GGIQLWLHFDY |
| | | SEQ ID NO: 136 | SEQ ID NO: 137 | SEQ ID NO: 138 |
| 26F12 27B3 | NA | AACTACTATATGTCC | ATAATCAACCCTAGTGGTGGT GACTCAACCTACGCACAGAAG TTCCAGGGC | GGGGGGATACAACTATGGTT ACATTTTGACTAC |
| | | SEQ ID NO: 139 | SEQ ID NO: 140 | SEQ ID NO: 141 |
| | AA | NYYMS | IINPSGGDSTYAQKFQG | GGIQLWLHFDY |
| | | SEQ ID NO: 142 | SEQ ID NO: 143 | SEQ ID NO: 144 |
| 26D1 | NA | AGCTACTATATGTCC | ATAATCCACCCTAGTGGTGGT GACACAACCTACGCACAGAAG TTCCAGGGC | GGGGGGATAAAACTATGGTT ACATTTTGACTAT |
| | | SEQ ID NO: 145 | SEQ ID NO: 146 | SEQ ID NO: 147 |
| | AA | SYYMS | IIHPSGGDTTYAQKFQG | GGIKLWLHFDY |
| | | SEQ ID NO: 148 | SEQ ID NO: 149 | SEQ ID NO: 150 |
| 25G10 | NA | GGTTACTACTGGAGC | TATATCTATTACATTGGGAGC ACCAACTACAACCCCTCCCTC AAGAGT | GATGGGAGCAGTGGCTGGTA CCGGTGGTTCGACCCC |
| | | SEQ ID NO: 151 | SEQ ID NO: 152 | SEQ ID NO: 153 |
| | AA | GYYWS | YIYYIGSTNYNPSLKS | DGSSGWYRWFDP |
| | | SEQ ID NO: 154 | SEQ ID NO: 155 | SEQ ID NO: 156 |
| 23A10 | NA | CGCTATGGCATACAC | GTTATATGGTATGATGGAAGT AATAAATACTATGCAGACTCC GTGAAGGGC | AGGGCCGGTATACCTGGAAC TACGGGCTACTACTATGGTA TGGACGTC |
| | | SEQ ID NO: 157 | SEQ ID NO: 158 | SEQ ID NO: 159 |
| | AA | RYGIH | VIWYDGSNKYYADSVKG | RAGIPGTTGYYYGMDV |
| | | SEQ ID NO: 160 | SEQ ID NO: 161 | SEQ ID NO: 162 |
| 19B5 | NA | AGCTACTTTATTCAC | ATTATCAACCCTATTAGTGTT AGCACAAGCTACGCACAGAAG TTCCAGGGC | GGGGGGATACAGCTATGGTT ACATTTGGACTAC |
| | | SEQ ID NO: 163 | SEQ ID NO: 164 | SEQ ID NO: 165 |
| | AA | SYFIH | IINPISVSTSYAQKFQG | GGIQLWLHLDY |
| | | SEQ ID NO: 166 | SEQ ID NO: 167 | SEQ ID NO: 168 |
| b: LIGHT CHAIN CDRs | | | | |
| 1D10 2C12 | NA | TCTGGAGATAGATTGG GGGAAAAATATACTTGC | CAAGATACCAAGCGGCCCTCA | CAGGCGTGGGACAGCAGCAC TGTGGTA |
| | | SEQ ID NO: 169 | SEQ ID NO: 170 | SEQ ID NO: 171 |
| | AA | SGDRLGEKYTC | QDTKRPS | QAWDSSTVV |
| | | SEQ ID NO: 172 | SEQ ID NO: 173 | SEQ ID NO: 174 |
| 1F10 | NA | AGGGCCAGTCGGAGTA TTAGCAGCAGCTACTT AGCC | GGTCCATCCAGCAGGGCCACT | CAGCAGTATGGTAGCTCATT CACT |
| | | SEQ ID NO: 175 | SEQ ID NO: 176 | SEQ ID NO: 177 |
| | AA | RASRSISSSYLA | GPSSRAT | QQYGSSFT |
| | | SEQ ID NO: 178 | SEQ ID NO: 179 | SEQ ID NO: 180 |
| 2C12_LC#1 | NA | AGGtCTAGTCAAAGcc tcgtaTACAGTGATGG AAACAcctACTTGAAT | AAGGTTTCTAACTGGGactct | ATGCAAGGTATAGTGTGGCC GTGCAGT |
| | | SEQ ID NO: 181 | SEQ ID NO: 182 | SEQ ID NO: 183 |
| | AA | RSSQSLVYSDGNTYLN | KVSNWDS | MQGIVWPCS |
| | | SEQ ID NO: 184 | SEQ ID NO: 185 | SEQ ID NO: 186 |
| 2G6_LC#1 | NA | AGGTCTAGTCAAAGCC TCGTATACAGTGATGG AAACACCTACTTGAAT | CAGGTTTCTAACTGGGACTCT | ATGCAAGATACACTGTGGCC GTGCAGT |
| | | SEQ ID NO: 187 | SEQ ID NO: 188 | SEQ ID NO: 189 |
| | AA | RSSQSLVYSDGNTYLN | QVSNWDS | MQDTLWPCS |
| | | SEQ ID NO: 190 | SEQ ID NO: 191 | SEQ ID NO: 192 |

TABLE I-continued

| Ab | Type | CDR 1 | CDR 2 | CDR 3 |
|---|---|---|---|---|
| 2G6 | NA | TCTGGAGATAGGTTGG GGGAAAAATATACTTGC | CAAGATACCAAGCGGCCCTCA | CAGGCGTGGGACAGCAGCAC TGTGGTA |
| | | SEQ ID NO: 193 | SEQ ID NO: 194 | SEQ ID NO: 195 |
| | AA | SGDRLGEKYTC | QDTKRPS | QAWDSSTVV |
| | | SEQ ID NO: 196 | SEQ ID NO: 197 | SEQ ID NO: 198 |
| 2H12 | NA | TCTGGAGATAGATTGG GGGAAAAATATACTTGC | CAAGATACCAAGCGGCCCTCA | CAGGCGTGGGACAGCAGCAC TGTGGTA |
| | | SEQ ID NO: 199 | SEQ ID NO: 200 | SEQ ID NO: 201 |
| | AA | SGDRLGEKYTC | QDTKRPS | QAWDSSTVV |
| | | SEQ ID NO: 202 | SEQ ID NO: 203 | SEQ ID NO: 204 |
| 2H12_LC#2 | NA | AGGTCTAGTCAAAGCC TCGTATACAGTGATGG AAACACCTACTTGAAT | AAGGTTTCTAACTGGGACTCT | ATGCAAGATACACTGTGGCC GTGCAGT |
| | | SEQ ID NO: 205 | SEQ ID NO: 206 | SEQ ID NO: 207 |
| | AA | RSSQSLVYSDGNTYLN | KVSNWDS | MQDTLWPCS |
| | | SEQ ID NO: 208 | SEQ ID NO: 209 | SEQ ID NO: 210 |
| 4A2 5B4 5C5 | NA | AGGgcCAGTCGGAATA TTAGCAGCAGCTACtt aGCC | GGTCCATCCAGCAGGGccaCT | CAGCAGTATGGtagctCATT CACT |
| | | SEQ ID NO: 211 | SEQ ID NO: 212 | SEQ ID NO: 213 |
| | AA | RASRNISSSYLA | GPSSRAT | QQYGSSFT |
| | | SEQ ID NO: 214 | SEQ ID NO: 215 | SEQ ID NO: 216 |
| 4A9 | NA | ACTGGGAGCAGCTCCA ACATCGGGACAGGTTA TGCTGTACAC | GGTAACAACAATCGGCCCTCA | CAGTCCTATGACAGCagACT GAGTGGTTGGGTG |
| | | SEQ ID NO: 217 | SEQ ID NO: 218 | SEQ ID NO: 219 |
| | AA | TGSSSNIGTGYAVH | GNNNRPS | QSYDSRLSGWV |
| | | SEQ ID NO: 220 | SEQ ID NO: 221 | SEQ ID NO: 222 |
| 4B10 4C2 | NA | AGGGCCAGTCAGAGTG TTAGCAACACCTACTT AGCC | GGTGCATCCAGCAGGGCCACT | CAGCAGTACAGTAACTCgtg GACG |
| | | SEQ ID NO: 223 | SEQ ID NO: 224 | SEQ ID NO: 225 |
| | AA | RASQSVSNTYLA | GASSRAT | QQYSNSWT |
| | | SEQ ID NO: 226 | SEQ ID NO: 227 | SEQ ID NO: 228 |
| 4D2 | NA | AGGGCCAGTCAGAGTG TTAGCAACACCTACTT AGCC | GGTGCATCCAGCAGGGCCGCT | CagcagTATAGTAacTcgtg GACG |
| | | SEQ ID NO: 229 | SEQ ID NO: 230 | SEQ ID NO: 231 |
| | AA | RASQSVSNTYLA | GASSRAA | QQYSNSWT |
| | | SEQ ID NO: 232 | SEQ ID NO: 233 | SEQ ID NO: 234 |
| 4D3 4F3 | NA | AGGGCCAGTCAGAGTG TTAGCAGCAGCTACTT AGCC | GGTGCATCCAGCAGGGCCACT | CAGCAGTATGGTAGCTCGTG GACG |
| | | SEQ ID NO: 235 | SEQ ID NO: 236 | SEQ ID NO: 237 |
| | AA | RASQSVSSSYLA | GASSRAT | QQYGSSWT |
| | | SEQ ID NO: 238 | SEQ ID NO: 239 | SEQ ID NO: 240 |
| 4E10 | NA | AGGGCCAGTCAGAGTG TTGGCAGCAGCTACTT AGCC | GGTGCATCCAGCAGGGTCACT | CAGCAATATAGTAACTCGTG GACG |
| | | SEQ ID NO: 241 | SEQ ID NO: 242 | SEQ ID NO: 243 |
| | AA | RASQSVGSSYLA | GASSRVT | QQYSNSWT |
| | | SEQ ID NO: 244 | SEQ ID NO: 245 | SEQ ID NO: 246 |
| 4F7 | NA | ACTGGGAGCAGCTCCA ATATCGGGACAGGTTA TGATGTACAC | GGTAACAGCAATCGGCCCTCA | CAGTCCTATGACAGCAGTCT GAGTGGTTGGGTG |
| | | SEQ ID NO: 247 | SEQ ID NO: 248 | SEQ ID NO: 249 |
| | AA | TGSSSNIGTGYDVH | GNSNRPS | QSYDSSLSGWV |
| | | SEQ ID NO: 250 | SEQ ID NO: 251 | SEQ ID NO: 252 |
| 5E3 | NA | TCTGGAGATAAATTGG GGGATGAATATGCTTGC | CAAGATAGCAAGCGGCCCTCA | CAGGCGTGGGACAGCAGCAC TGTGGTA |
| | | SEQ ID NO: 253 | SEQ ID NO: 254 | SEQ ID NO: 255 |
| | AA | SGDKLGDEYAC | QDSKRPS | QAWDSSTVV |
| | | SEQ ID NO: 256 | SEQ ID NO: 257 | SEQ ID NO: 258 |

TABLE I-continued

| Ab | Type | CDR 1 | CDR 2 | CDR 3 |
|---|---|---|---|---|
| 17H8<br>23B6<br>28D10 | NA | AGGGCCAGTCAGAGTG<br>TTGCCGGCAGCTACCT<br>AGCC | GGTGCATCCAGCAGGGCCACT | CAGCAGTATGGTAAATCACC<br>GATCACC |
| | | SEQ ID NO: 259 | SEQ ID NO: 260 | SEQ ID NO: 261 |
| | AA | RASQSVAGSYLA | GASSRAT | QQYGKSPIT |
| | | SEQ ID NO: 262 | SEQ ID NO: 263 | SEQ ID NO: 264 |
| 16C1 | NA | AGGGCCAGCCAGAGTG<br>TTAGCAGCAGCTACTT<br>AGCC | GGTGCATCCAGCAGGGCCACT | CAGCAGTATGGTAACTCACC<br>GCTCACT |
| | | SEQ ID NO: 265 | SEQ ID NO: 266 | SEQ ID NO: 267 |
| | AA | RASQSVSSSYLA | GASSRAT | QQYGNSPLT |
| | | SEQ ID NO: 268 | SEQ ID NO: 269 | SEQ ID NO: 270 |
| 16A4 | NA | AGGGCCAGTCAGAGTG<br>TTAGCAGCAGTTATTT<br>AGCC | GGTACATCCAGCAGGGCCACT | CAGCAGTACGGTAGCTCACC<br>TTTCACT |
| | | SEQ ID NO: 271 | SEQ ID NO: 272 | SEQ ID NO: 273 |
| | AA | RASQSVSSSYLA | GTSSRAT | QQYGSSPFT |
| | | SEQ ID NO: 274 | SEQ ID NO: 275 | SEQ ID NO: ***276 |
| 16E2<br>17E10<br>20B12 | NA | CGGGCGAGTCAGGGCA<br>TTAGCAATTATTTAGCC | GCTGCATCCAGTTTGCAAAGT | CAACACTATTTTACTTACCC<br>TCGGACG |
| | | SEQ ID NO: 277 | SEQ ID NO: 278 | SEQ ID NO: 279 |
| | AA | RASQGISNYLA | AASSLQS | QHYFTYPRT |
| | | SEQ ID NO: 280 | SEQ ID NO: 281 | SEQ ID NO: 282 |
| 22G10 | NA | AGGGCCAGTCAGAGTA<br>TTAGCAGCAACTTAGCC | GGTGCATTTACCAGGGCCACT | CAGCAGTATAATTACTGGCC<br>GCTCACT |
| | | SEQ ID NO: 283 | SEQ ID NO: 284 | SEQ ID NO: 285 |
| | AA | RASQSISSNLA | GAFTRAT | QQYNYWPLT |
| | | SEQ ID NO: 286 | SEQ ID NO: 287 | SEQ ID NO: 288 |
| 16H2<br>20D3<br>23E7 | NA | TCTGGAAGCAGCTCCA<br>ACATCGGAAGTAATTT<br>TGTAAAC | ACTAATAATCAGCGGCCCTCA | GCAACATGGGATGACAGCCT<br>GAATGGTTGGGTG |
| | | SEQ ID NO: 289 | SEQ ID NO: 290 | SEQ ID NO: 291 |
| | AA | SGSSSNIGSNFVN | TNNQRPS | ATWDDSLNGWV |
| | | SEQ ID NO: 292 | SEQ ID NO: 293 | SEQ ID NO: 294 |
| 22D1 | NA | TCTGGAAGCAGCTCCA<br>ACATCGGAAGCAATTT<br>TGTAAAC | ACTAATAATCAGCGGCCCTCA | GCAACATGGGATGACAGTAT<br>GAATGGTTGGGTG |
| | | SEQ ID NO: 295 | SEQ ID NO: 296 | SEQ ID NO: 297 |
| | AA | SGSSSNIGSNFVN | TNNQRPS | ATWDDSMNGWV |
| | | SEQ ID NO: 298 | SEQ ID NO: 299 | SEQ ID NO: 300 |
| 25F8 | NA | TCTGGAAGCAGCTCCA<br>ACATCGGAAGGAATTT<br>TGTAAAC | ACTAATAATCAGCGGCCCTCA | GCAGCATGGGATGACAGCCT<br>GAATGGTTGGGTG |
| | | SEQ ID NO: 301 | SEQ ID NO: 302 | SEQ ID NO: 303 |
| | AA | SGSSSNIGRNFVN | TNNQRPS | AAWDDSLNGWV |
| | | SEQ ID NO: 304 | SEQ ID NO: 305 | SEQ ID NO: 306 |
| 26F12<br>27B3 | NA | TCTGGAAGCCGCTCCA<br>ACATCGGAAGTAATTT<br>TGTAAAC | ACTAATTATCAGCGGCCCTCA | GCAGTATGGGATGACAGCCT<br>GAATGGTTGGGTG |
| | | SEQ ID NO: 307 | SEQ ID NO: 308 | SEQ ID NO: 309 |
| | AA | SGSRSNIGSNFVN | TNYQRPS | AVWDDSLNGWV |
| | | SEQ ID NO: 310 | SEQ ID NO: 311 | SEQ ID NO: 312 |
| 26D1 | NA | TCTGGAAGCCGCTCCA<br>ACATCGGAAGTAATTT<br>TGTAAAC | ACTAATAATCAGCGGCCCTCA | GCAGTATGGGATGACAGCCT<br>GAATGGTTGGGTG |
| | | SEQ ID NO: 313 | SEQ ID NO: 314 | SEQ ID NO: 315 |
| | AA | SGSRSNIGSNFVN | TNNQRPS | AVWDDSLNGWV |
| | | SEQ ID NO: 316 | SEQ ID NO: 317 | SEQ ID NO: 318 |
| 25G10 | NA | AGGGCCAGTCAGAGTG<br>TTAGCAGCAGCTACTT<br>AGCC | GGTGCATCCAGCAGGGCCACT | CAGCAGTATGGTAACTCACC<br>GCTCACT |
| | | SEQ ID NO: 319 | SEQ ID NO: 320 | SEQ ID NO: 321 |
| | AA | RASQSVSSSYLA | GASSRAT | QQYGNSPLT |
| | | SEQ ID NO: 322 | SEQ ID NO: 323 | SEQ ID NO: 324 |

TABLE I-continued

| Ab | Type | CDR 1 | CDR 2 | CDR 3 |
|---|---|---|---|---|
| 23A10 | NA | TCTGGAGATAGATTGG GGGAGAAATATGTTTGC | CAAGATAATAAGTGGCCCTCA | CAGGCGTGGGACAGCAGcac TGTGGTA |
|  |  | SEQ ID NO: 325 | SEQ ID NO: 326 | SEQ ID NO: 327 |
|  | AA | SGDRLGEKYVC | QDNKWPS | QAWDSSTVV |
|  |  | SEQ ID NO: 328 | SEQ ID NO: 329 | SEQ ID NO: 330 |
| 19B5 | NA | TCTGGAAGCAGGTCCA ACATCGGAAGCAATTT TGTAAAC | ACTAATAATCAGCGGCCCTCA | GCAACATGGGATGACAGTAT GAATGGTTGGGTG |
|  |  | SEQ ID NO: 331 | SEQ ID NO: 332 | SEQ ID NO: 333 |
|  | AA | SGSRSNIGSNFVN | TNNQRPS | ATWDDSMNGWV |
|  |  | SEQ ID NO: 334 | SEQ ID NO: 335 | SEQ ID NO: 336 |

Anti-CDH19 Variable Region Amino Acid Sequences and Polynucleotide Sequences

TABLE II a: Heavy Chain Variable Region Polynucleotide and Amino acid Sequences

| SEQ ID NO. | DESIGNATION | SOURCE | TYPE | SEQUENCE |
|---|---|---|---|---|
| 337 | 17H8 23B6 28D10 | artificial | nt | CAGGTGCAGCTGCAGGAGTCGGGCCCAGGACTGGTGAAGCCTT CGGAGACCCTGTCCCTCACGTGCACTGTCTCTGGTGGCTCCAT CAATAGTTACTACTGGAGCTGGATCCGGCAGCCCCCAGGGAAG GGACTGGAGTGGATTGGGTATATCTATTACATTGGGAGCACCA ACTACAACCCCTCCCTCAAGAGTCGCGTCACCATATCAGTAGA CACGTCCAAGAACCAGTTCTCCCTGAAGCTGAGCTCTGTGACC GCTGCGGACACGGCCCTGTATTACTGTGCGAGAGATTCCCGGT ATAGAAGTGGCTGGTACGATGCTTTTGATATCTGGGGCCAAGG GACAATGGTCACCGTCTCTTCA |
| 338 | 17H8 23B6 28D10 | artificial | aa | QVQLQESGPGLVKPSETLSLTCTVSGGSINSYYWSWIRQPPGK GLEWIGYIYYIGSTNYNPSLKSRVTISVDTSKNQFSLKLSSVT AADTALYYCARDSRYRSGWYDAFDIWGQGTMVTVSS |
| 339 | 4A2 5B4 5C5 | artificial | nt | CAGGTGCAGCTGCAGGAGTCGGGCCCAGGACTGGTGAAGCCTT CACAGACCCTGTCCCTCACCTGCACTGTCTCTGGTGGCTCCAT CAGCAGTAGTGGTTACTACTGGAGCTGGATCCGCCAGCACCCA GGGAAGGGCCTGGAGTGGATTGGGTACATCTATTACACTGGGA GCGCCTACTACAACCCGTCCCTCAAGAGTCGAGTTACCATATC AGTAGACACGTCTAAGAACCAGTTCTCCCTGAAGCTGAGCTCT GTGACTGCCGCGGACACGGCCGTGTATTACTGTGCGAGAGATG GAAGCAGTGGCTGGTACTTCCAGTATGGGGCCAGGGCACCCT GGTCACCGTCTCCTCA |
| 340 | 4A2 5B4 5C5 | artificial | aa | QVQLQESGPGLVKPSQTLSLTCTVSGGSISSSGYYWSWIRQHP GKGLEWIGYIYYTGSAYYNPSLKSRVTISVDTSKNQFSLKLSS VTAADTAVYYCARDGSSGWYFQYWGQGTLVTVSS |
| 341 | 16H2 20D3 23E7 | artificial | nt | CAGGTGCAGCTGGTGCAGTCTGGGGCTGAGGTGAAGAAGCCTG GGGCCTCAGTGAAGGTTTCCTGCAAGGTTTCTGGATACACCTT CACCAGCTACTTTATTCACTGGGTGCGCCAGGCCCCTGGACAA GGGCTTGAGTGGATGGGAATAATCAACCCTATTAGTGTTAGCA CAAGCTACGCACAGAAGTTCCAGGGCAGAGTCACCATGACCAG GGACACGTCCACGAGCACAGTCTTCATGGAGCTGAGCAGCCTG AGATCTGAGGACACGGCCGTGTATTACTGTGCGCGAGGGGGGA TACAGCTATGGTTACATTTTGACTACTGGGGCCAGGGAACCCT GGTCACCGTCTCCTCA |
| 342 | 16H2 20D3 23E7 | artificial | aa | QVQLVQSGAEVKKPGASVKVSCKVSGYTFTSYFIHWVRQAPGQ GLEWMGIINPISVSTSYAQKFQGRVTMTRDTSTSTVFMELSSL RSEDTAVYYCARGGIQLWLHFDYWGQGTLVTVSS |
| 343 | 26F12 27B3 | artificial | nt | CAGGTGCAGTTGGTGCAGTCTGGGGCTGAGGTGAAGAAGCCTG GGGCCTCAGTGAAGGTTTCCTGCAAGGCATCTAGATACACCTT CACCAACTACTATATGTCCTGGGTGCGACAGGCCCCTGGACAA GGGCTTGAGTGGATGGGAATAATCAACCCTAGTGGTGGTGACT CAACCTACGCACAGAAGTTCCAGGGCAGACTCACCATGACCGG GGACACGTCCACGAGCACAGTCTACATGGAGCTGAGCAGCCTG AGATCTGAGGACACGGCCGTGTATTACTGTGCGAGAGGGGGGA |

| | | | | |
|---|---|---|---|---|
| | | | | TACAACTATGGTTACATTTTGACTACTGGGGCCAGGGAACCCT GGTCACCGTCTCCTCA |
| 344 | 26F12 27B3 | artificial | aa | QVQLVQSGAEVKKPGASVKVSCKASRYTFTNYYMSWVRQAPGQ GLEWMGIINPSGGDSTYAQKFQGRLTMTGDTSTSTVYMELSSL RSEDTAVYYCARGGIQLWLHFDYWGQGTLVTVSS |
| 345 | 4B10 4C2 | artificial | nt | CAGGTGCAGTTGGTGGAGTCTGGGGGAGGCGTGGTCCAGCCTG GGAGGTCCCTGAGACTCTCCTGTGCAGCCTCTGGATTCACCTT CAGTAGCTATGACATGCACTGGGTCCGCCAGGCTCCAGGCAAG GGGCTGGAGTGGGTGGCAGTTATATCATATGATGGAACTAATG AATACTATGCAGACTCCGTGAAGGGCCGATTCACCATCTCCAG AGACACTTCCAAGAACACGCTGTATTTGCAAATGAACAGCCTG AGAGCTGAGGACACGGCTGTATATTACTGTGCGAGAGAACGAT ATTTTGACTGGTCTTTTGACTACTGGGGCCAGGGAACCCTGGT CAGTGTCTCCTCA |
| 346 | 4B10 4C2 | artificial | aa | QVQLVESGGGVVQPGRSLRLSCAASGFTFSSYDMHWVRQAPGK GLEWVAVISYDGTNEYYADSVKGRFTISRDTSKNTLYLQMNSL RAEDTAVYYCARERYFDWSFDYWGQGTLVSVSS |
| 347 | 4D3 4F3 | artificial | nt | CAGGTGCAGCTGGTGGAGTCTGGGGGAGGCGTGGTCCAGCCTG GGAGGTCCCTGAGACTCTCCTGTGCAGCGTCTGGATTCTCCTT CAGTAGCTATGACATGGACTGGGTCCGCCAGACTCCAGGCAAG GGGCTGGAGTGGGTGGCAGTTATATGGTATGATGGAAGTAATA AATACTATGCAGACTCCGTGAGGGGCCGATTCACCATCTCCAG AGACAATTCCAAGAACACGCTGTTTCTGCAAATGAACAGCCTG AGAGTCGAGGACACGGCTGTGTATTACTGTGCGAGAGAAACTG GGGAGGGCTGGTACTTCGATCTCTGGGGCCGTGGCACCCTGGT CACTGTCTCCTCA |
| 348 | 4D3 4F3 | artificial | aa | QVQLVESGGGVVQPGRSLRLSCAASGFSFSSYDMDWVRQTPGK GLEWVAVIWYDGSNKYYADSVRGRFTISRDNSKNTLFLQMNSL RVEDTAVYYCARETGEGWYFDLWGRGTLVTVSS |
| 349 | 16E2 17E10 20B12 | artificial | nt | CAGGTGCAGCTGGTGGAGTCTGGGGGAGGCGTGGTCCAGCCTG GGAGGTCCCTGAGACTCTCCTGTGCAGCGTCTGGATTCATCTT CAGTAGCTATGGCATGCACTGGGTCCGCCAGACTCCAGGCAAG GGGCTGGAGTGGGTGGCAGTGATATGGTATGATGGAAGTAATA AATACTATGCAGACTCCGTGAAGGGCCGATTCACCATCTCCAG AGACATTTCCAAGAACACGCTGTATCTGCAAATGAACAGCCTG AGAGTCGAGGACACGGCTGTGTATTACTGTGCGAGAGACGGGT GGGAGCTGTCCTTTGACTACTGGGGCCAGGGAACCCTGGTCAC CGTCTCCTCA |
| 350 | 16E2 17E10 20B12 | artificial | aa | QVQLVESGGGVVQPGRSLRLSCAASGFIFSSYGMHWVRQTPGK GLEWVAVIWYDGSNKYYADSVKGRFTISRDISKNTLYLQMNSL RVEDTAVYYCARDGWELSFDYWGQGTLVTVSS |
| 351 | 1D10 2C12 | artificial | nt | CAGGTGCAGCTGGTGGAGTCTGGGGGAGGCGTGGTCCAGCCTG GGAGGTCCCTGAGACTCTCCTGTGCAGCGTCTGGATTCACCTT CAGTAGCTATGGCATGCACTGGGTCCGCCAGGCTCCAGGCAAG GGGCTGGAGTGGGTGTCAGTTATATGGTATGATGGAAGTAATA AATACTATGCAGACTCCGTGAAGGGCCGATTCACCATCTCCAG AGACAATTCCAAGAACACGCTGTATCTGCAAATGAATAGCCTG AGAGCTGAGGACACGGCTGTGTATTACTGCGCGAGAAGGGCCG GTATAATAGGAACTACAGGCTACTACTACGGTATGGACGTCTG GGGCCAAGGGACCACGGTCACCGTCTCCTCA |
| 352 | 1D10 2C12 | artificial | aa | QVQLVESGGGVVQPGRSLRLSCAASGFTFSSYGMHWVRQAPGK GLEWVSVIWYDGSNKYYADSVKGRFTISRDNSKNTLYLQMNSL RAEDTAVYYCARRAGIIGTTGYYYGMDVWGQGTTVTVSS |
| 353 | 16C1 | artificial | nt | CAGGTGCAGCTGCAGGAGTCGGGCCCAGGACTGGTGAAGCCTT CGGAGACCCTGTCCCTCACTTGTACTGTCTCTGGTGGCTCCAT CAGTGGTTACTACTGGAGCTGGATCCGGCAGCCCCCAGGGAAG GGACTGGAGTGGATTGGGTATATCTATTACATTGGGAGCACCA ACTACAACCCCTCCCTCAAGAGTCGAGTCACCATGTCAATAGA CACGTCCAAGAACCAGTTCTCCCTGACGCTGAGCTCTTTGACC GCTGCGGACACGGCCGTGTATTTCTGTGCGAGAGATGGGAGCA GTGGCTGGTACCGGTGGTTCGACCCCTGGGGCCAGGGAACCCT GGTCACCGTCTCCTCA |
| 354 | 16C1 | artificial | aa | QVQLQESGPGLVKPSETLSLTCTVSGGSISGYYWSWIRQPPGK GLEWIGYIYYIGSTNYNPSLKSRVTMSIDTSKNQFSLTLSSLT AADTAVYFCARDGSSGWYRWFDPWGQGTLVTVSS |
| 355 | 25G10 | artificial | nt | CAGGTGCAGCTGCAGGAGTCGGGCCCAGGACTGGTGAAGCCTT CGGAGACCCTGTCCCTCACCTGCACTGTCTCTGGTGGCTCCAT CAGTGGTTACTACTGGAGCTGGATCCGGCAGCCCCCAGGGAAG |

TABLE II-continued

|   |   |   |   |   |
|---|---|---|---|---|
|   |   |   |   | GGACTGGAGTGGATTGGGTATATCTATTACATTGGGAGCACCA ACTACAACCCCTCCCTCAAGAGTCGAGTCACCATGTCAGTAGA CACGTCCAAGAACCAGTTCTCCTGAAGCTGAGCTCTGTGACC GCTGCGGACACGGCCGTGTATTACTGTGCGAGAGATGGGAGC GTGGCTGGTACCGGTGGTTCGACCCCTGGGGCCAGGGAACCCT GGTCACCGTCTCCTCA |
| 356 | 25G10 | artificial | aa | QVQLQESGPGLVKPSETLSLTCTVSGGSISGYYWSWIRQPPGK GLEWIGYIYYIGSTNYNPSLKSRVTMSVDTSKNQFSLKLSSVT AADTAVYYCARDGSSGWYRWFDPWGQGTLVTVSS |
| 357 | 16A4 | artificial | nt | CAGGTGCAGCTGCAGGAGTCgGGCCCAGGACTGGCGAAgcctt cGGAGACcctgtccctcacctgCACTGTCTCTGGTGACTCCAT CACTAGTTACTACTGGAGCTGGATCCGGCAGCCCCCAGGGAAG GACTGGAGTGGATTGGGTATATCTATTACAGTGGGAGCACCA ATTACAACCCCTCCCTCAAGAGTCGAGTCACCATATCAGTAGA CACGTCCAAGAACCAGTTCTCCTGAAGCTGAGTTCTGTGACC GCTGCGGACACGGCCGTGTATTACTGTGCGAGAGATCAAAGGC GGATAGCAGCAGCTGGTACCCACTTCTACGGTATGGACGTCTG GGGCCAAGGGACCACGGTCACCGTCTCCTCA |
| 358 | 16A4 | artificial | aa | QVQLQESGPGLAKPSETLSLTCTVSGDSITSYYWSWIRQPPGK GLEWIGYIYYSGSTNYNPSLKSRVTISVDTSKNQFSLKLSSVT AADTAVYYCARDQRRIAAAGTHFYGMDVWGQGTTVTVSS |
| 359 | 1F10 | artificial | nt | CAGGTGCAGCTGCAGGAGTCGGGCCCAGGACTGGTGAAGCCTT CACAGACCCTGTCCCTCACCTGCACTGTCTCTGGTGGCTCCAT CAGCAGTGGTGGTTACTACTGGAGCTGGATCCGCCAGCACCCA GGGAAGGGCCTGGAGTGGATTGGGTACATCTATTACAGTGGGA GCACCTACTACAACCCGTCCCTCACGAGTCGAGTTACCATATC AGTAGACACGTCTAAGAACCAGTTCTCCCTGAAGCTGAGCTCT GTGACTGCCGCGGACACGGCCGTGTATTACTGTGCGAGAGATG GAAGCAGTGGCTGGTACTTCCAGCACTGGGGCCAGGGCACCCT GGTCACCGTCTCCTCA |
| 360 | 1F10 | artificial | aa | QVQLQESGPGLVKPSQTLSLTCTVSGGSISSGGYYWSWIRQHP GKGLEWIGYIYYSGSTYYNPSLTSRVTISVDTSKNQFSLKLSS VTAADTAVYYCARDGSSGWYFQHWGQGTLVTVSS |
| 361 | 4A9 | artificial | nt | CAGGTGCAGCTGCAGGAGTCGGGCCCAGGACTGGTGAAGCCTT CGGAGACCCTGTCCCTCACCTGCACTGTCTCTGGTGGCTCCAT CAGTGGTTACTACTGGAGCTGGATCCGGCAGCCCCCAGGAAAG GGACTGGAGTGGTTTGCATATTTCTCTTACAGTGGGAGCACCA ACTACAACCCCTCCCTCAAGAGTCGAGTCACCTTATCAGTAGA CACGTCCAAGAACCAGTTCTCCTGAAGCTGAGCTCTGTGACC GCTGCGGACACGGCCGTGTATTACTGTGCGAGGAACTGGGCCT TCCACTTTGACTTCTGGGGCCAGGGAACCCTGGTCACCGTCTC CTCA |
| 362 | 4A9 | artificial | aa | QVQLQESGPGLVKPSETLSLTCTVSGGSISGYYWSWIRQPPGK GLEWFAYFSYSGSTNYNPSLKSRVTLSVDTSKNQFSLKLSSVT AADTAVYYCARNWAFHFDFWGQGTLVTVSS |
| 363 | 4F7 | artificial | nt | CAGGTGCAGCTGCAGGAGTCGGGCCCAGGACTGGTGAAGCCTT CGGAGACCCTGTCCCTCACCTGCACTGTCTCTGGTGGCTCCAT CAGTAGTTACTCCTGGAGCTGGATCCGGCAGCCCCCAGGGAAG GGACTGGAGTGGATTGGGTATATCTATTACAGTGGGAGCACCA ACTACAACCCCTCCCTCAAGAGTCGAGTCACCATATCATTAGA CACGTCCAAGAACCAGTTCTCCTGAAGCTGAGCTCTGTGACC GCTGCGGACACGGCCGTGTATTACTGTGCGAGGAACTGGGCCT TCCACTTTGACTACTGGGGCCAGGGAACCCTGGTCACCGTCTC CTCA |
| 364 | 4F7 | artificial | aa | QVQLQESGPGLVKPSETLSLTCTVSGGSISSYSWSWIRQPPGK GLEWIGYIYYSGSTNYNPSLKSRVTISLDTSKNQFSLKLSSVT AADTAVYYCARNWAFHFDYWGQGTLVTVSS |
| 365 | 22D1 | artificial | nt | CAGGTGCAGCTGGTGCAGTCTGGGGCTGAGGTGAAGAAGCCTG GGGCCTCAGTGAGGGTTTCCTGCAAGGTTTCTGGATACACCTT CACCAGCTACTTTATTCACTGGGTACGCCAGGCCCCTGGACAA GGGCTTGAGTGGATGGGAATAATCAACCCTATTAGTGTTAGCA CAAGCTACGCACAGAAGTTCCAGGGCAGAGTCACCATGACCAG GGACACGTCCACGAGCACAGTCTTCATGGAGCTGAGCAGCCTG AGATCTGAGGACACGGCCGTGTATTACTGTGCGCGAGGGGGGA TACAGCTATGGTTACATTTGGACTACTGGGGCCAGGGAACCCT GGTCACCGTCTCCTCA |
| 366 | 22D1 | artificial | aa | QVQLVQSGAEVKKPGASVRVSCKVSGYTFTSYFIHWVRQAPGQ GLEWMGIINPISVSTSYAQKFQGRVTMTRDTSTSTVFMELSSL RSEDTAVYYCARGGIQLWLHLDYWGQGTLVTVSS |

TABLE II-continued

| | | | | |
|---|---|---|---|---|
| 367 | 19B5 | artificial | nt | CAGGTGCAGTTGGTGCAGTCTGGGGCTGAGGTGAAGAAGCCTG GGGCCTCAGTGAAGGTTTCCTGCAAGGTTTCTGGATACACCTT CACCAGCTACTTTATTCACTGGGTGCGCCAGGCCCCTGGACAA GGGCTTGAATGGATGGGAATTATCAACCCTATTAGTGTTAGCA CAAGCTACGCACAGAAGTTCCAGGGCAGAGTCACCATGACCAG GGACACGTCCACGAGCACAGTCTTCATGGAGCTGAGCAGcCTG AGATCTGAGGACACGGCCGTGTATTACTGTGCGCGAGGGGGA TACAGCTATGGTTACATTTGGACTACTGGGGCCAGGGAACCCT GGTCACCGTCTCCTCA |
| 368 | 19B5 | artificial | aa | QVQLVQSGAEVKKPGASVKVSCKVSGYTFTSYFIHWVRQAPGQ GLEWMGIINPISVSTSYAQKFQGRVTMTRDTSTSTVFMELSSL RSEDTAVYYCARGGIQLWLHLDYWGQGTLVTVSS |
| 369 | 25F8 | artificial | nt | CAGGTGCAGCTGGTGCAGTCTGGGGCTGAGGTGAAGAAGCCTG GGGCCTCAGTGAAGGTTTCCTGCAAGGCATCTGGATACACCTT CACCAGCTACTATATTCACTGGGTGCGCCAGGCCCCTGGACAA GGACTTGAGTGGATGGGAATAATCAACCCCAGTGGTGGTAGCA CAAGGTACGCACAGAAGTTCCAGGGCAGAGTCACCATGACCAG GGACACGTCCACGAGCACAGTCTTCATGGAGCTGAGCagcctG AGATCTGAGGACACGGCCGTGTATTACTGTGCGCGAGGGGGAA TACAGCTATGGTTACATTttGACTACTGGGGCCAGGGAACCCT GGTCACCGTCTCCTCA |
| 370 | 25F8 | artificial | aa | QVQLVQSGAEVKKPGASVKVSCKASGYTFTSYYIHWVRQAPGQ GLEWMGIINPSGGSTRYAQKFQGRVTMTRDTSTSTVFMELSSL RSEDTAVYYCARGGIQLWLHFDYWGQGTLVTVSS |
| 371 | 26D1 | artificial | nt | CAGGTGCAGTTGGTGCAGTCTGGGGCTGAGGTGAAGAAGCCTG GGGCCTCAGTGAAGGTTTCCTGTAAGGCATCTAGATACACCTT CACCAGCTACTATATGTCCTGGGTGCGACAGGCCCCTGGACAA GGGCTTGAGTGGATGGGAATAATCCACCCTAGTGGTGGTGACA CAACCTACGCACAGAAGTTCCAGGGCAGAGTCACCATGACCGG GGACACGTCCACGAGCACAGTCTACATGGAGCTGAGCAGCCTG AGATCTGAGGACACGGCCGTGTATTACTGTGCGAGAGGGGGA TAAAACTATGGTTACATTTTGACTATTGGGGCCAGGGAACCCT GGTCACCGTCTCCTCA |
| 372 | 26D1 | artificial | aa | QVQLVQSGAEVKKPGASVKVSCKASRYTFTSYYMSWVRQAPGQ GLEWMGIIHPSGGDTTYAQKFQGRVTMTGDTSTSTVYMELSSL RSEDTAVYYCARGGIKLWLHFDYWGQGTLVTVSS |
| 373 | 4D2 | artificial | nt | CAGGTGCAGCTGGTGGAGTCTGGGGGAGGCGTGGTCCAGCCTG GGAGGTCCCTGAGACTCTCCTGTGCAGCCTCTGGATTCACCTT CAGTAGTTATGACATGCACTGGGTCCGCCAGGCTCCAGGCAAG GGGCTGGAGTGGGTGGCAGTTATATCATATGATGGAACTAATG AATACTATGCAGACTCCGTGAAGGGCCGATTCACCATCTCCAG AGACACTTCCAAGAACACGCTGTATTTGCAAATGAACAGCCTG AGAGCTGAGGACACGGCTGTATATTACTGTGCGAGAGAACGAT ATTTTGACTGGTCTTTTGACTACTGGGGCCAGGGAACCCTGGT CAGTGTCTCCTCA |
| 374 | 4D2 | artificial | aa | QVQLVESGGGVVQPGRSLRLSCAASGFTFSSYDMHWVRQAPGK GLEWVAVISYDGTNEYYADSVKGRFTISRDTSKNTLYLQMNSL RAEDTAVYYCARERYFDWSFDYWGQGTLVSVSS |
| 375 | 4E10 | artificial | nt | CAGGTGCAGCTGGTGGAGTCTGGGGGAGGCGTGGTCCAGCCTG GGAGGTCCCTGAGACTCTCCTGTGCAGCGTCTGGATTCACCTT CAGTAGCTATGACATGCACTGGGTCCGCCAGGCTCCAGGCAAG GGGCTGGAGTGGGTGGCAGTTATATGGTATGATGGAAGTAATA AATACTATGCAGACTCCGTGAAGGGCCGATTCACCATCTCCAG AGACAATTCCACGAACACGCTGCATCTGCAAATGAACAGCCCG AGAGCCGAGGACACGGCTGTGTACTACTGTGCGAGAGAGTATA GGTACAGCTGGTACTTTGACTACTGGGGCCAGGGAACCCTGGT CACCGTCTCCTCA |
| 376 | 4E10 | artificial | aa | QVQLVESGGGVVQPGRSLRLSCAASGFTFSSYDMHWVRQAPGK GLEWVAVIWYDGSNKYYADSVKGRFTISRDNSTNTLHLQMNSP RAEDTAVYYCAREYRYSWYFDYWGQGTLVTVSS |
| 377 | 22G10 | artificial | nt | GAGGTGCAACTGTTGGAGTCTGGGGGAGGCTTGGTACAGCCTG GGGGGTCCCTGAGACTCTCCTGTGCAGCCTCTGGATTCACCTT TAGCAGTTATGCCATGAACTGGGTCCGCCAGGCTCCAGGGAAG GGCTGGAGTGGGTCTCAACTATTAGTGGTGGTGGTGCTAACA CATACTACGCAGACTCCGTGAAGGGCCGGTTCACCATCTCCAG TGACAATTCCAAGAGCACGCTGTATCTGCAAATGAACAGCCTG AGAGCCGCGGACACGGCCGTATATCACTGTGCGAAAGGGGGAA TGGGGGGATACTACTACGGTATGGACGTCTGGGGCCAAGGGAC CACGGTCACCGTCTCCTCA |

| | | | |
|---|---|---|---|
| 378 | 22G10 | artificial aa | EVQLLESGGGLVQPGGSLRLSCAASGFTFSSYAMNWVRQAPGK<br>GLEWVSTISGGGANTYYADSVKGRFTISSDNSKSTLYLQMNSL<br>RAADTAVYHCAKGGMGGYYYGMDVWGQGTTVTVSS |
| 379 | 2C12_LC#1 | artificial nt | CAGGTGCAGCTGGTGGAGTCTGGGGGAGGCGTGGTCCAGCCTG<br>GGAGGTCCCTGAGACTCTCCTGTGCAGCGTCTGGATTCACCTT<br>CAGTAGCTATGGCATGCACTGGGTCCGCCAGGCTCCAGGCAAG<br>GGGCTGGAGTGGGTGTCAGTTATATGGTATGATGGAAGTAATA<br>AATACTATGCAGACTCCGTGAAGGGCCGATTCACCATCTCCAG<br>AGACAATTCCAAGAACACGCTGTATCTGCAAATGAATAGCCTG<br>AGAGCTGAGGACACGGCTGTGTATTACTGCGCGAGAAGGGCCG<br>GTATAATAGGAACTACAGGCTACTACTACGGTATGGACGTCTG<br>GGGCCAAGGGACCACGGTCACCGTCTCCTCA |
| 380 | 2C12_LC#1 | artificial aa | QVQLVESGGGVVQPGRSLRLSCAASGFTFSSYGMHWVRQAPGK<br>GLEWVSVIWYDGSNKYYADSVKGRFTISRDNSKNTLYLQMNSL<br>RAEDTAVYYCARRAGIIGTTGYYYGMDVWGQGTTVTVSS |
| 381 | 2H12_LC#2 | artificial nt | CAGGTGCAGCTGGTGGAGTCTGGGGGAGGCGTGGTCCAGCCTG<br>GGAGGTCCCTGAGACTCTCCTGTGCAGCGTCTGGATTCACCTT<br>CAGTAGCTATGGCATGCACTGGGTCCGCCAGGCTCCAGGCAAG<br>GGGCTGGAGTGGGTGGCAGTTATATGGTATGATGGAAGTAATA<br>AATACTATACAGACTCCGTGAAGGGCCGATTCACCATCTCCAG<br>AGACAATTCCAAGAACACGCTGTATCTGCAAATGAATAGCCTG<br>AGAGCTGAGGACACGGCTGTGTATTACTGTGCGAGAAGGGCCG<br>GTATAATAGGAACTACAGGCTACTACACGGTATGGACGTCTG<br>GGGCCAAGGGACCACGGTCACCGTCTCCTCA |
| 382 | 2H12_LC#2 | artificial aa | QVQLVESGGGVVQPGRSLRLSCAASGFTFSSYGMHWVRQAPGK<br>GLEWVAVIWYDGSNKYYTDSVKGRFTISRDNSKNTLYLQMNSL<br>RAEDTAVYYCARRAGIIGTTGYYYGMDVWGQGTTVTVSS |
| 383 | 2G6_LC#1 | artificial nt | CAGGTGCAGTTGGTGGAGTCTGGGGGAGGCGTGGTCCAGCCTG<br>GGAGGTCCCTGAGACTCTCCTGTGCAGCGTCTGGATTCACCTT<br>CAGTAGCTATGGCATGCACTGGGTCCGCCAGGCTCCAGGCAAG<br>GGGCTGGAGTGGGTGGCATTTATATGGTATGATGGAAGTAATA<br>AATACTATGCAGACTCCGTGAAGGACCGATTCACCATCTCCAG<br>AGACAATTCCAAGAACACGCTGTATCTGCAAATGAAAAGCCTG<br>AGAGCTGAGGACACGGCTGTGTATTACTGTGCGAGAAGGGCCG<br>GTATAATAGGAACTATAGGCTACTACTACGGTATGGACGTCTG<br>GGGCCAAGGGACCACGGTCACCGTCTCCTCA |
| 384 | 2G6_LC#1 | artificial aa | QVQLVESGGGVVQPGRSLRLSCAASGFTFSSYGMHWVRQAPGK<br>GLEWVAFIWYDGSNKYYADSVKDRFTISRDNSKNTLYLQMKSL<br>RAEDTAVYYCARRAGIIGTIGYYYGMDVWGQGTTVTVSS |
| 385 | 2H12 | artificial nt | CAGGTGCAGCTGGTGGAGTCTGGGGGAGGCGTGGTCCAGCCTG<br>GGAGGTCCCTGAGACTCTCCTGTGCAGCGTCTGGATTCACCTT<br>CAGTAGCTATGGCATGCACTGGGTCCGCCAGGCTCCAGGCAAG<br>GGGCTGGAGTGGGTGGCAGTTATATGGTATGATGGAAGTAATA<br>AATACTATACAGACTCCGTGAAGGGCCGATTCACCATCTCCAG<br>AGACAATTCCAAGAACACGCTGTATCTGCAAATGAATAGCCTG<br>AGAGCTGAGGACACGGCTGTGTATTACTGTGCGAGAAGGGCCG<br>GTATAATAGGAACTACAGGCTACTACACGGTATGGACGTCTG<br>GGGCCAAGGGACCACGGTCACCGTCTCCTCA |
| 386 | 2H12 | artificial aa | QVQLVESGGGVVQPGRSLRLSCAASGFTFSSYGMHWVRQAPGK<br>GLEWVAVIWYDGSNKYYTDSVKGRFTISRDNSKNTLYLQMNSL<br>RAEDTAVYYCARRAGIIGTTGYYYGMDVWGQGTTVTVSS |
| 387 | 2G6 | artificial nt | CAGGTGCAGTTGGTGGAGTCTGGGGGAGGCGTGGTCCAGCCTG<br>GGAGGTCCCTGAGACTCTCCTGTGCAGCGTCTGGATTCACCTT<br>CAGTAGCTATGGCATGCACTGGGTCCGCCAGGCTCCAGGCAAG<br>GGGCTGGAGTGGGTGGCATTTATATGGTATGATGGAAGTAATA<br>AATACTATGCAGACTCCGTGAAGGACCGATTCACCATCTCCAG<br>AGACAATTCCAAGAACACGCTGTATCTGCAAATGAAAAGCCTG<br>AGAGCTGAGGACACGGCTGTGTATTACTGTGCGAGAAGGGCCG<br>GTATAATAGGAACTATAGGCTACTACTACGGTATGGACGTCTG<br>GGGCCAAGGGACCACGGTCACCGTCTCCTCA |
| 388 | 2G6 | artificial aa | QVQLVESGGGVVQPGRSLRLSCAASGFTFSSYGMHWVRQAPGK<br>GLEWVAFIWYDGSNKYYADSVKDRFTISRDNSKNTLYLQMKSL<br>RAEDTAVYYCARRAGIIGTIGYYYGMDVWGQGTTVTVSS |
| 389 | 23A10 | artificial nt | CAGGTGCAGCTGGTGGAGTCTGGGGGAGGCGTGGTCCAGCCTG<br>GGAGGTCCCTGAGACTCTCCTGTGCAGCGTCTGGATTCACCTT<br>CAGTCGCTATGGCATACACTGGGTCCGCCAGGCTCCAGGCAAG<br>GGGCTGGAGTGGGTGGCAGTTATATGGTATGATGGAAGTAATA<br>AATACTATGCAGACTCCGTGAAGGGCCGATTCACCATCTCCAG |

TABLE II-continued

```
              AGACAATTCCAAGAACACGCTGTATCTGCTAATGAACAGCCTG
              AGAGCCGAGGACTCGGCTGTGTATTACTGTGCGAGAAGGGCCG
              GTATACCTGGAACTACGGGCTACTACTATGGTATGGACGTCTG
              GGGCCAAGGGACCACGGTCACCGTCTCCTCA 390 23A10    artificial aa  QVQLVESGGGVVQPGRSLRLSCAASGFTFSRYGIHWVRQAPGK
                            GLEWVAVIWYDGSNKYYADSVKGRFTISRDNSKNTLYLLMNSL
                            RAEDSAVYYCARRAGIPGTTGYYYGMDVWGQGTTVTVSS 391 5E3      artificial nt  GAGGTGCAGTTGGTGGAGTCTGGGGGAGGCCTGGTCAAGCCTG
                            GGGGGTCCCTGAGACTCTCCTGTGCAGCCTCTGGATTCACCTT
                            CAGTAGCTATAGCATGCACTGGGTCCGCCAGGCTCCAGGGAAG
                            GGGCTGGAGTGGGTCTCATCCATTAGTAGTAGTAGTAGTTACA
                            TATACTACGCAGACTCAGTGAAGGGCCGATTCACCATCTCCAG
                            AGACAACGCCAAGAACTCACTGTATCTGCAAATGAACAGCCTG
                            AGAGCCGAGGACACGGCTGTGTATTACTGTGCGAGAGGGGAAA
                            CTGGAACTAACTACTACTACTACGGTATGGACGTCTGGGGCCA
                            AGGGACCACGGTCACCGTCTCCTCA 392 5E3      artificial aa  EVQLVESGGGLVKPGGSLRLSCAASGFTFSSYSMHWVRQAPGK
                            GLEWVSSISSSSSYIYYADSVKGRFTISRDNAKNSLYLQMNSL
                            RAEDTAVYYCARGETGTNYYYYGMDVWGQGTTVTVSS
```

B: Light Chain Variable Region Polynucleotide and Amino acid Sequences

```
SEQ
ID
NO. DESIGNATION SOURCE     TYPE SEQUENCE 393 17H8        artificial nt   GACATTGTATTGACGCAGtctCCAGGCACCCTGTCTTTGTCTC
    23B6                        CAGGGGAAAGAGCCACCCTCTCCTGCAGGGCCAGTCAGAGTGT
    28D10                       TGCCGGCAGCTACCTAGCCTGGTACCAGCAGAAACCTGGCCAG
                                GCTCCCAGGCTCCTCATCTCTGGTGCATCCAGCAGGGCCACTG
                                GCATCCCAGACAGGTTCAGTGGCAGTGGGTCTGGGACAGACTT
                                CACTCTCACCATCAGCAGACTGGAGCCTGAAGATTTTGCAGTG
                                TATTACTGTCAGCAGTATGGTAAATCACCGATCACCTTCGGCC
                                AAGGGACACGACTGGAGATGAAAGGA 394 17H8        artificial aa   DIVLTQSPGTLSLSPGERATLSCRASQSVAGSYLAWYQQKPGQ
    23B6                        APRLLISGASSRATGIPDRFSGSGSGTDFTLTISRLEPEDFAV
    28D10                       YYCQQYGKSPITFGQGTRLEMKG 395 4A2         artificial nt   GAAATTGTGTTGACGCAGTCTCCAGGCACCCTGTCTTTGTCTC
    5B4                         CAGGGGAAAGAGCCACCCTCTCTTGCAGGGCCAGTCGGAATAT
    5C5                         TAGCAGCAGCTACTTAGCCTGGTACCAGCAGAAACCTGGCCAG
                                GCTCCCAGGCTCCTCATCTATGGTGCATCCAGCAGGGCCACTG
                                GCATCCCAGACAGGTTCAGTGGCAGTGGGTCTGGGACAGACTT
                                CACTCTCACCATCAGCAGACTGGAGCCTGAAGATTTTACAGTG
                                TATTACTGTCAGCAGTATGGTAGCTCATTCACTTTCGGCCCTG
                                GGACCAAAGTGGATATCAAACGA 396 4A2         artificial aa   EIVLTQSPGTLSLSPGERATLSCRASRNISSSYLAWYQQKPGQ
    5B4                         APRLLIYGPSSRATGIPDRFSGSGSGTDFTLTISRLEPEDFTV
    5C5                         YYCQQYGSSFTFGPGTKVDIKR 397 16H2        artificial nt   CAGTCTGCGCTGACTCAGCCACCCTCAGCGACTGGGACCCCCG
    20D3                        GGCAGAGGGTCACCATCTCTTGTTCTGGAAGCAGCTCCAACAT
    23E7                        CGGAAGTAATTTTGTAAACTGGTACAAACAACTCCCAGGAACG
                                GCCCCCAAAGTCCTCATCTATACTAATAATCAGCGGCCCTCAG
                                GGGTCCCTGACCGATTCTCTGGCTCCAAGTCTGGCACCTCAGC
                                CTCCCTGGCCATCAGTGGGCTCCAGTCTGAGGATGAGTCTGAT
                                TATTACTGTGCAACATGGGATGACAGCCTGAATGGTTGGGTGT
                                TCGGCGGAGGGACCAAGCTGACCGTCCTAGGT 398 16H2        artificial aa   QSALTQPPSATGTPGQRVTISCSGSSSNIGSNFVNWYKQLPGT
    20D3                        APKVLIYTNNQRPSGVPDRFSGSKSGTSASLAISGLQSEDESD
    23E7                        YYCATWDDSLNGWVFGGGTKLTVLG 399 26F12       artificial nt   CAGTCTGTGCTGACTCAGTCACCCTCAGCGTCTGGGACCCCCG
    27B3                        GGCAGAAGGTCACCATCTCTTGTTCTGGAAGCCGCTCCAACAT
                                CGGAAGTAATTTTGTAAACTGGTACCAGCAGCTCCCAGGAACG
                                GCCCCCAAACTCCTCATCTATACTAATTATCAGCGGCCCTCAG
                                GGGTCCCTGACCGATTCTCTGGCTCCAAGTCTGGCACCTCAGC
                                CTCCCTGGCCATCAGTGGGCTCCAGTCTGAGGATGAGGCTGAT
                                TATTACTGTGCAGTATGGGATGACAGCCTGAATGGTTGGGTGT
                                TCGGCGGAGGGACCAAGCTGACCGTCCTAGGT 400 26F12       artificial aa   QSVLTQSPSASGTPGQKVTISCSGSRSNIGSNFVNWYQQLPGT
    27B3                        APKLLIYTNYQRPSGVPDRFSGSKSGTSASLAISGLQSEDEAD
                                YYCAVWDDSLNGWVFGGGTKLTVLG
```

TABLE II-continued

| | | | |
|---|---|---|---|
| 401 | 4B10 4C2 | artificial nt | GAAATTGTATTGACGCAGTCTCCAGGCACCCTGTCTTTGTCTC CAGGGGAAAGAGCCACCCTCTCCTGCAGGGCCAGTCAGAGTGT TAGCAACACCTACTTAGCCTGGTACCATCAGAGACCTGGCCAG GCTCCCAGGCTCCTCATCTATGGTGCATCCAGCAGGGCCACTG GCATCCCAGACAGATTCAGTGGCAGTGGGTCTGGGACAGACTT CGCTCTCACCATCAGCAGTCTGGAGCCTGAAGATTTTGCAGTG TATTACTGTCAGCAGTACAGTAACTCgtgGACGTTCGGCCAAG GGACCAAGGTGGAAATCAaacGA |
| 402 | 4B10 4C2 | artificial aa | EIVLTQSPGTLSLSPGERATLSCRASQSVSNTYLAWYHQRPGQ APRLLIYGASSRATGIPDRFSGSGSGTDFALTISSLEPEDFAV YYCQQYSNSWTFGQGTKVEIKR |
| 403 | 4D3 4F3 | artificial nt | GAAATTGTGTTGACGCAGTCTCCAGGCACCCTGTCTTTGTCTC CAGGGGAAAGAGCCACCCTCTCCTGCAGGGCCAGTCAGAGTGT TAGCAGCAGCTACTTAGCCTGGTACCAGCAGAAACCTGGCCAG GCTCCCAGGCTCCTCATCTATGGTGCATCCAGCAGGGCCACTG GCATCCCAGACAGGTTCAGTGGCAGTGGGTCTGGGACAGACTT CACTCTCACCATCAGCAGACTGGAACCTGAGGATTTTGCAGTG TATTACTGTCAGCAGTATGGTAGCTCGTGGACGTTCGGCCAAG GGACCAAGGTGGAAATCAAACGA |
| 404 | 4D3 4F3 | artificial aa | EIVLTQSPGTLSLSPGERATLSCRASQSVSSSYLAWYQQKPGQ APRLLIYGASSRATGIPDRFSGSGSGTDFTLTISRLEPEDFAV YYCQQYGSSWTFGQGTKVEIKR |
| 405 | 16E2 17E10 20B12 | artificial nt | GACATCCAGATGACCCAGTCTCCATCCTCACTGTCTGCATCTG TAGGAGACAGAGTCACCATCACTTGTCGGGCGAGTCAGGGCAT TAGCAATTATTTAGCCTGGTTACAGCAGAAACCAGGGAAAGCC CCTAAGTCCCTGATCTATGCTGCATCCAGTTTGCAAAGTGGGG TCCCATCAAAGTTCAGCGGCAGTGGATCTGGGACAGATTTCAC TCTCACCATCAGCAGCCTGCAGCCTGAAGATTTTGCAACTTAT TACTGCCAACACTATTTTACTTACCCTCGGACGTTCGGCCAAG GGACCAAGGTGGAAATCAAACGA |
| 406 | 16E2 17E10 20B12 | artificial aa | DIQMTQSPSSLSASVGDRVTITCRASQGISNYLAWLQQKPGKA PKSLIYAASSLQSGVPSKFSGSGSGTDFTLTISSLQPEDFATY YCQHYFTYPRTFGQGTKVEIKR |
| 407 | 1D10 2C12 | artificial nt | TCCTATGCGCTGACTCAGCCACCCTCAGTGTCCGTGTCCCCAG GACAGACAGCCAGCCTCACCTGCTCTGGAGATAGATTGGGGGA AAAATATACTTGCTGGTATCAGCAGAGGCCAGGCCAGTCCCCT TTGCTGGTCATCTATCAAGATACCAAGCGGCCCTCAGGGATCC CTGAGCGATTCTCTGGCTCCACCTCTGGTAACACAGCCACTCT GACCATCAGCGGGACCCAGGCTATGGATGAGGCTGACTATTAC TGTCAGGCGTGGGACAGCAGCACTGTGGTATTCGGCGGAGGGA CCAAGCTGACCGTCCTAGGT |
| 408 | 1D10 2C12 | artificial aa | SYALTQPPSVSVSPGQTASLTCSGDRLGEKYTCWYQQRPGQSP LLVIYQDTKRPSGIPERFSGSTSGNTATLTISGTQAMDEADYY CQAWDSSTVVFGGGTKLTVLG |
| 409 | 16C1 | artificial nt | GAAATTGTGTTGACGCAGTCTCCAGGCACCCTGTCTTTGTCTC CAGGGGAAAGAGCCACCCTCTCCTGCAGGGCCAGCCAGAGTGT TAGCAGCAGCTACTTAGCCTGGTACCAGCAGAAACCTGGCCAG GCTCCCAGGCTCCTCATCTTTGGTGCATCCAGCAGGGCCACTG GCATCCCAGACAGGTTCAGTGGCAGTGGGTCTGGGACAGACTT CACTCTCACCATCAGCGGACTGGAGCCTGAAGATTTTGCAGTG TATCACTGTCAGCAGTATGGTAACTCACCGCTCACTTTCGGCG GAGGGACCAAGGTGGAGATCAAACGA |
| 410 | 16C1 | artificial aa | EIVLTQSPGTLSLSPGERATLSCRASQSVSSSYLAWYQQKPGQ APRLLIFGASSRATGIPDRFSGSGSGTDFTLTISGLEPEDFAV YHCQQYGNSPLTFGGGTKVEIKR |
| 411 | 25G10 | artificial nt | GAAATTGTGTTGACGCAGTCTCCAGGCACCCTGTCTTTGTCTC CAGGGGAAAGAGCCACCCTCTCCTGCAGGGCCAGTCAGAGTGT TAGCAGCAGCTACTTAGCCTGGTACCAGCAGAAACCTGGCCAG GCTCCCAGGCTCCTCATCTTTGGTGCATCCAGCAGGGCCACTG GCATCCCAGACAGGTTCAGTGGCAGTGGGTCTGGGACAGactT CACTCTCACCATCAGCAGACTGGAGCCTGAAGATTTTGCAGTG TATCACTGTCAGCAGTATGGTAACTCACCGCTCACTTTCGGCG GAGGGACCAAGGTGGAGATCAAACGA |
| 412 | 25G10 | artificial aa | EIVLTQSPGTLSLSPGERATLSCRASQSVSSSYLAWYQQKPGQ APRLLIFGASSRATGIPDRFSGSGSGTDFTLTISRLEPEDFAV YHCQQYGNSPLTFGGGTKVEIKR |

TABLE II-continued

| | | | |
|---|---|---|---|
| 413 16A4 | artificial | nt | GAAATTGTGTTGACGCAGTCTCCAGGCACCCTGTCTTTGTCTC
CAGGGGAAAGAGCCACCCtCTCCTGCAGGGCCAGTCAGAGTGT
TAGCAGCAGTTATTTAGCCTGGTACCAGCAGAAACCTGGCCAG
GCTCCCAGGCTCCTCATCTATGGTACATCCAGCAGGGCCACTG
GCATCCCAGACAGGTTCAGTGGCAGTGGGTCTGGGACAGACTT
CACTCTCACCATCAGCAGACTGGAGCCTGAAGATTTTGCAGTG
TATTATTGTCAGCAGTACGGTAGCTCACCTTTCACTTTCGGCG
GAGGGACCAAGGTGGAGATCAAACGA |
| 414 16A4 | artificial | aa | EIVLTQSPGTLSLSPGERATLSCRASQSVSSSYLAWYQQKPGQ
APRLLIYGTSSRATGIPDRFSGSGSGTDFTLTISRLEPEDFAV
YYCQQYGSSPFTFGGGTKVEIKR |
| 415 1F10 | artificial | nt | GAAATTGTGTTGACGCAGTCTCCAGGCACCCTGTCTTTGTCTC
CAGGGGAAAGAGCCACCCTCTCCTGCAGGGCCAGTCGGAGTAT
TAGCAGCAGCTACTTAGCCTGGTACCAGCAGAAACCTGGCCAG
GCTCCCAGGCTCCTCATCTATGGTCCATCCAGCAGGGCCACTG
GCATCCCAGACAGGTTCAGTGGCAGTGGGTCTGGGACAGACTT
CACTCTCACCATCAGCAGACTGGAGCCTGAAGATTTTGCAGTG
TATTACTGTCAGCAGTATGGTAGCTCATTCACTTTCGGCCCTG
GGACCAAAGTGGATATCAAACGA |
| 416 1F10 | artificial | aa | EIVLTQSPGTLSLSPGERATLSCRASRSISSSYLAWYQQKPGQ
APRLLIYGPSSRATGIPDRFSGSGSGTDFTLTISRLEPEDFAV
YYCQQYGSSFTFGPGTKVDIKR |
| 417 4A9 | artificial | nt | CAGTCTGTGCTGACGCAGCCGCCCTCAGTGTCTGGGGCCCCAG
GACAGAGGGTCACCATCTCCTGCACTGGGAGCAGCTCCAACAT
CGGGACAGGTTATGCTGTATACACTGGTACCAGCAGTTTCCAGGA
ACAGCCCCCAAACTCCTCATCTATGGTAACAACAATCGGCCCT
CAGGGGTTCCTGACCGATTCTCTGGCTCCAAGTCTGGCACCTC
AGCCTCCCTGGCCATCACTGGGCTCCAGGCTGAGGATGAGGCT
GATTATTACTGCCAGTCCTATGACAGCAGACTGAGTGGTTGGG
TGTTCGGCGGAGGGACCAAGCTGACCGTCCTAGGT |
| 418 4A9 | artificial | aa | QSVLTQPPSVSGAPGQRVTISCTGSSSNIGTGYAVHWYQQFPG
TAPKLLIYGNNNRPSGVPDRFSGSKSGTSASLAITGLQAEDEA
DYYCQSYDSRLSGWVFGGGTKLTVLG |
| 419 4F7 | artificial | nt | CAGTCTGTgcTGACGCAGCCGCCCTCAGTGTCTGGGGCCCCAG
GGCAGAGGGTCACCATCTCCTGCACTGGGAGCAGCTCCAATAT
CGGGACAGGTTATGATGTACACTGGTATCAGCAGcttcCAGGA
ACAGCCCCCAAACTCCTCATCCATGGTAACAGCAATCGGCCCT
CAGGGGGTCCCTGACCGATTCTCTGGCTCCAAGTCTGGCACCTC
AGCCTCCCTGGCCATCACTGGGCTCCAGGCTGAGGATGAGGCT
GATTATTACTGCCAGTCCTATGACAGCAGTCTGAGTGGTTGGG
TGTTCGGCGGAGGGACCAGGTTGACCGTCCTAGGT |
| 420 4F7 | artificial | aa | QSVLTQPPSVSGAPGQRVTISCTGSSSNIGTGYDVHWYQQLPG
TAPKLLIHGNSNRPSGVPDRFSGSKSGTSASLAITGLQAEDEA
DYYCQSYDSSLSGWVFGGGTRLTVLG |
| 421 22D1 | artificial | nt | CAGTCTGCGCTGACTCAGCCACCCTCAGCGACTGGGACCCCCG
GGCAGAGGGTCACCATCTCTTGTTCTGGAAGCAGCTCCAACAT
CGGAAGCAATTTTGTAAACTGGTACAAGCAGCTCCCAGGAACG
GCCCCCAAAGTCCTCATCTATACTAATAATCAGCGGCCCTCAG
GGGTCCCTGACCGATTCTCTGGCTCCAAGTCTGGCACCTCAGC
CTCCCTGGCCATCAGTGGGCTCCAGTCTGAGGATGAGTCTGAT
TATTACTGTGCAACATGGGATGACAGTATGAATGGTTGGGTGT
TCGGCGGAGGGACCAAGCTGACCGTCCTAGGT |
| 422 22D1 | artificial | aa | QSALTQPPSATGTPGQRVTISCSGSSSNIGSNFVNWYKQLPGT
APKVLIYTNNQRPSGVPDRFSGSKSGTSASLAISGLQSEDESD
YYCATWDDSMNGWVFGGGTKLTVLG |
| 423 19B5 | artificial | nt | CAGTCTGCGCTGACTCAGCCACCCTCAACGACTGGGACCCCCG
GGCAGAGGGTCACCATCTCTTGTTCTGGAAGCAGGTCCAACAT
CGGAAGCAATTTTGTAAACTGGTACAAGCAGCTCCCAGGAACG
GCCCCCAAAGTCCTCATCTATACTAATAATCAGCGGCCCTCAG
GGGTCCCTGACCGATTCTCTGGCTCCAAGTCTGGCACCTCAGC
CTCCCTGGCCATCAGTGGGCTCCAGTCTGAGGATGAGTCTGAT
TATTACTGCGCAACATGGGATGACAGTATGAATGGTTGGGTGT
TCGGCGGAGGGACCAAACTGACCGTCCTAGGT |
| 424 19B5 | artificial | aa | QSALTQPPSTTGTPGQRVTISCSGSRSNIGSNFVNWYKQLPGT
APKVLIYTNNQRPSGVPDRFSGSKSGTSASLAISGLQSEDESD
YYCATWDDSMNGWVFGGGTKLTVLG |

TABLE II-continued

| 425 | 25F8 | artificial | nt | CAGTCTGCGCTGactCAGCCACCCTCAGCGACTGGGACCCCG
GGCAGAGGGTCACCATCTCTTGTTCTGGAAGCAGCTCCAACAT
CGGAAGGAATTTTGTAAACTGGTATAAGCAGCTCCCAGGAACG
GCCCCCAAAGTCCTCATTTATACTAATAATCAGCGGCCCTCAG
GGGTCCCTGACCGATTCTCTGGCTCCAAGTCTGGCACCTCAGC
CTCCCTGGCCATCAGTGGGCTCCAGTCTGAGGATGAGTCTGAT
TATTACTGTGCAGCATGGGATGACAGCCTGAATGGTTGGGTGT
TCGGCGGAGGGACCAAGCTGACCGTCCTAGGT |
| 426 | 25F8 | artificial | aa | QSALTQPPSATGTPGQRVTISCSGSSSNIGRNFVNWYKQLPGT
APKVLIYTNNQRPSGVPDRFSGSKSGTSASLAISGLQSEDESD
YYCAAWDDSLNGWVFGGGTKLTVLG |
| 427 | 26D1 | artificial | nt | CACTCTGTGCTGACTCAGTCACCCTCAGCGTCTGGGACCCCG
GACAGAGGGTCACCATCTCTTGTTCTGGAAGCCGCTCCAACAT
CGGAAGTAATTTTGTAAACTGGTACCAGCAGCTCCCAGGAACG
GCCCCCAAACTCCTCATCTATACTAATAATCAGCGGCCCTCAG
GGGTCCCTGACCGATTCTCTGGCTCCAAGTCTGGCACCTCAGC
CTCCCTGGCCATCAGTGGGCTCCAGTCTGAGGATGAGGCTGAT
TATTACTGTGCAGTATGGGATGACAGCCTGAATGGTTGGGTGT
TCGGCGGAGGGACCAAGCTGACCGTCCTAGGT |
| 428 | 26D1 | artificial | aa | HSVLTQSPSASGTPGQRVTISCSGSRSNIGSNFVNWYQQLPGT
APKLLIYTNNQRPSGVPDRFSGSKSGTSASLAISGLQSEDEAD
YYCAVWDDSLNGWVFGGGTKLTVLG |
| 429 | 4D2 | artificial | nt | GAAATTGTATTGACGCAGTCTCCAGGCACCCTGTCTTTGTCTC
CAGGGGAAAGAGCCACCCTCTCCTGCAGGGCCAGTCAGAGTGT
TAGCAACACCTACTTAGCCTGGTACCATCAGAGACCTGGCCAG
GCTCCCAGGCTCCTCATCTATGGTGCATCCAGCAGGGCCGCTG
GCATCCCAGACAGGTTCAGTGGCAGTGGGTCTGGGACAGACTT
CACTCTCACCATCAGCAGACTGGAGCCTGAAGATTTTGCAGTG
TATTACTGTCAGCAGTATAGTAACTCGTGGACGTTCGGCCAAG
GGACCAAGGTGGAAATCAAACGA |
| 430 | 4D2 | artificial | aa | EIVLTQSPGTLSLSPGERATLSCRASQSVSNTYLAWYHQRPGQ
APRLLIYGASSRAAGIPDRFSGSGSGTDFTLTISRLEPEDFAV
YYCQQYSNSWTFGQGTKVEIKR |
| 431 | 4E10 | artificial | nt | GAAATTGTGTTGACGCAGTCTCCAGGCACCCTGTCTTTGTCTC
CAGGGGAAAGAGCCACCCTCTCCTGCAGGGCCAGTCAGAGTGT
TGGCAGCAGCTACTTAGCCTGGTACCAGCAGAAACCTGGCCAG
GCTCCCAGGCTCCTCATCTATGGTGCATCCAGCAGGGTCACTG
GCATCCCAGACAGGTTCAGTGGCAGTGGGTCTGGGACAGATTT
CACTCTCACCATCAGCAGACTGGAGCCTGAAGATTTTGCAGTG
TATTACTGTCAGCAATATAGTAACTCGTGGACGTTCGGCCAAG
GGACCAAGGTGGAAATCAAACGA |
| 432 | 4E10 | artificial | aa | EIVLTQSPGTLSLSPGERATLSCRASQSVGSSYLAWYQQKPGQ
APRLLIYGASSRVTGIPDRFSGSGSGTDFTLTISRLEPEDFAV
YYCQQYSNSWTFGQGTKVEIKR |
| 433 | 22G10 | artificial | nt | GAAATAGTGATGACGCAGTCTCCAGTCACCCTGTCTCTGTCTC
TAGGGGAAAGAGCCACCCTCTCCTGCAGGGCCAGTCAGAGTAT
TAGCAGCAACTTAGCCTGGTTCCAGCAGAAACCTGGCCAGGCT
CCCAGACTCCTCATCTATGGTGCATTTACCAGGGCCACTGGTA
TCCCAGCCAGGGTCAGTGGCAGTGGGTCTGGGACAGAGTTCAC
TCTCACCATCAGCAGCCTGCAGTCTGAAGATTTTGCAGTTTAT
TACTGTCAGCAGTATAATTACTGGCCGCTCACTTTCGGCGGAG
GGACCAAGGTGGAGATCAAGCGA |
| 434 | 22G10 | artificial | aa | EIVMTQSPVTLSLSLGERATLSCRASQSISSNLAWFQQKPGQA
PRLLIYGAFTRATGIPARVSGSGSGTEFTLTISSLQSEDFAVY
YCQQYNYWPLTFGGGTKVEIKR |
| 435 | 2C12_LC#1 | artificial | nt | GATGTTGTGATGactCAGtCTccActctccctgcCCGTCACCC
TTGGACAGCCGGcctCCAtctcctgCAGGtCTAGTCAAAGcct
cgtaTACAGTGATGGAAACAcctACTTGAATTGGTTTCAGCAG
AGGCCAGGCCAATCTCCAAGGcgcctaATTTATAAGGTTTCTA
ACTGGGactctGGGGtCCCAGACAGATTCAGCgGCAGTGGGTC
AGGCActGATTTCAcactGAAAAtCAGCAGGGTGGaggctgaG
GATGTTGGGGTTTATTactgCATGCAAGGTATAGTGTGGCCGT
GCAGTTTTGGCCAGGGGACCAAGCTGGAGATCAAaCgA |
| 436 | 2C12_LC#1 | artificial | aa | DVVMTQSPLSLPVTLGQPASISCRSSQSLVYSDGNTYLNWFQQ
RPGQSPRRLIYKVSNWDSVPDRFSGSGSGTDFTLKISRVEAE
DVGVYYCMQGIVWPCSFGQGTKLEIKR |

TABLE II-continued

| | | | | |
|---|---|---|---|---|
| 437 | 2H12_LC#2 | artificial | nt | GATGTTGTGATGACTCAGTCTCCACTCTCCCTGCCCGTCACCC TTGGACAGCCGGCCTCCATCTCCTGCAGGTCTAGTCAAAGCCT CGTATACAGTGATGGAAACACCTACTTGAATTGGTTTCAGCAG AGGCCAGGCCAATCTCCAAGGCGCCTAATTTATAAGGTTTCTA ACTGGGACTCTGGGGTCCCAGACAGAATCAGCGGCAGTGGGTC AGGCACCGATTTCACACTGAAAATCAGCAGGGTGGAGGCTGAG GATGTTGGGGTTTATTACTGCATGCAAGATACACTGTGGCCGT GCAGTTTTGGCCAGGGGACCAAGCTGGAGATCAAACGA |
| 438 | 2H12_LC#2 | artificial | aa | DVVMTQSPLSLPVTLGQPASISCRSSQSLVYSDGNTYLNWFQQ RPGQSPRRLIYKVSNWDSGVPDRISGSGSGTDFTLKISRVEAE DVGVYYCMQDTLWPCSFGQGTKLEIKR |
| 439 | 2G6_LC#1 | artificial | nt | GaTGTTGTGATGACTcagtctccACTCTCCCTGCCCGTCACCC ttggacaGCCGGCCTccaTCTCCTGCAGGTCTAGTCAAAGCCT CGTATACAGTGATGGAAACACCTACTTGAATTGGTTTCAGCAG AGGCCAGGCCAATCTCCACGGCGCCTAATTTATCAGGTTTCTA ACTGGGACTCTGGGGTCCCAGACAGATTCAGCGGCAGTGGGTC AGGCACTGATTTCACACTGAAAATCAGCAGGGTGGAGGCTGAG GATGTTGGGATTTATTACTGCATGCAAGATACACTGTGGCCGT GCAGTTTTGGCCAGGGGACCAAGCTGGAGATCAAACGA |
| 440 | 2G6_LC#1 | artificial | aa | DVVMTQSPLSLPVTLGQPASISCRSSQSLVYSDGNTYLNWFQQ RPGQSPRRLIYQVSNWDSGVPDRFSGSGSGTDFTLKISRVEAE DVGIYYCMQDTLWPCSFGQGTKLEIKR |
| 441 | 2H12 | artificial | nt | TCCTATGAGCTGACTCAGCCACCCTCAGTGTCCGTGTCCCCAG GACAGACAGCCAGCATCACCTGCTCTGGAGATAGATTGGGGGA AAAATATACTTGCTGGTATCAGCAGAGGCCAGGCCAGTCCCCT TTGCTGGTCATCTATCAAGATACCAAGCGGCCCTCAGGGATCC CTGAGCGATTCTCTGGCTCCAACTCTGGTAACACAGCCACTCT GACCATCAGCGGGACCCAGCCTATGGATGAGGCTGACTATTAC TGTCAGGCGTGGGACAGCAGCACTGTGGTATTCGGCGGAGGGA CCAAGCTGACCGTCCtAGGT |
| 442 | 2H12 | artificial | aa | SYELTQPPSVSVSPGQTASITCSGDRLGEKYTCWYQQRPGQSP LLVIYQDTKRPSGIPERFSGSNSGNTATLTISGTQPMDEADYY CQAWDSSTVVFGGGTKLTVLG |
| 443 | 2G6 | artificial | nt | TCCTATGAACTGACTCAGCCACCCTCAGTGTCCGTGTCCCCAG GACAGACAGCCAGCATCACCTGCTCTGGAGATAGGTTGGGGGA AAAATATACTTGCTGGTATCAGCAGAGGCCAGGCCAGTCCCCT TTGCTGGTCATCTATCAAGATACCAAGCGGCCCTCAGGGATCC CTGAGCGATTCTCTGGCTCCAACTCTGGTAACACAGCCACTCT GACCATCAGCGGGACCCAGGCTATGGATGAGGCTGACTATTAC TGTCAGGCGTGGGACAGCAGCACTGTGGTATTCGGCGGAGGGA CCAAGCTGACCGTCCTAGGT |
| 444 | 2G6 | artificial | aa | SYELTQPPSVSVSPGQTASITCSGDRLGEKYTCWYQQRPGQSP LLVIYQDTKRPSGIPERFSGSNSGNTATLTISGTQAMDEADYY CQAWDSSTVVFGGGTKLTVLG |
| 445 | 23A10 | artificial | nt | TCCTATGAGCTGACTCAGCCACCCTCAGTGTCCGTGTCCCCAG GACAGACAGCCAGCATCACCTGCTCTGGAGATAGATTGGGGGA GAAATATGTTTGCTGGTATCAGCAGAAGCCAGGCCAGTCCCCT ATACTGGTCATCTATCAAGATAATAAGTGGCCCTCAGGGATCC CTGAGCGATTCTCTGGCTCCAACTCTGGGAACACAGCCACTCT GACCATCAGCGGGACCCAGGCTATGGATGAGGCTGACTATTAC TGTCAGGCGTGGGACAGCAGCACTGTGGTATTCGGCGGGGGGA CCAAGCTGACCGTCCTAGGT |
| 446 | 23A10 | artificial | aa | SYELTQPPSVSVSPGQTASITCSGDRLGEKYVCWYQQKPGQSP ILVIYQDNKWPSGIPERFSGSNSGNTATLTISGTQAMDEADYY CQAWDSSTVVFGGGTKLTVLG |
| 447 | 5E3 | artificial | nt | TCCTATGAGCTGACTCAGCCACCCTCAGTGTCCGTGTCCCCAG GACAGACAGCCAGCATCACCTGCTCTGGAGATAAATTGGGGGA TGAATATGCTTGCTGGTATCAGCAGAAGCCAGGCCAGTCCCCT GTGCTGGTCATCTATCAAGATAGCAAGCGGCCCTCAGGGATCC CTGAGCGATTCTCTGGCTCCAACTCTGGGAACACAGCCACTCT GACCATCAGCGGGACCCAGGCTATGGATGAGGCTGACTATTAC TGTCAGGCGTGGGACAGCAGCACTGTGGTATTCGGCGGAGGGA CCAAGCTGACCGTCCTAGGT |

TABLE II-continued

| 448 | 5E3 | artificial | aa | SYELTQPPSVSVSPGQTASITCSGDKLGDEYACWYQQKPGQSPVLVIYQDSKRPSGIPERFSGSNSGNTATLTISGTQAMDEADYYCQAWDSSTVVFGGGTKLTVLG | c: Heavy Chain Variable Region Polynucleotide and Amino acid Sequences

13586_HC [hu anti-<huCDH19> 4F3 VH]
QVQLVESGGGVVQPGRSLRLSCAASGFSFSSYDMDWVRQTPGKGLEWVAVIWYDGSNKYYADSVRG

RFTISRDNSKNTLFLQMNSLRVEDTAVYYCARETGEGWYFDLWGRGTLVTVSS
SEQ ID NO: 449

13589_HC [hu anti-<huCDH19> 4A9 VH]
QVQLQESGPGLVKPSETLSLTCTVSGGSISGYYWSWIRQPPGKGLEWFAYFSYSGSTNYNPSLKSRVTLS

VDTSKNQFSLKLSSVTAADTAVYYCARNWAFHFDFWGQGTLVTVSS
SEQ ID NO: 450

13590_HC [hu anti-<huCDH19> 4B10 VH]
QVQLVESGGGVVQPGRSLRLSCAASGFTFSSYDMHWVRQAPGKGLEWVAVISYDGTNEYYADSVKGR

FTISRDTSKNTLYLQMNSLRAEDTAVYYCARERYFDWSFDYWGQGTLVSVSS
SEQ ID NO: 451

13874_HC [hu anti-<huCDH19> 17H8.2 VH]
QVQLQESGPGLVKPSETLSLTCTVSGGSINSYYWSWIRQPPGKGLEWIGYIYYIGSTNYNPSLKSRVTISV

DTSKNQFSLKLSSVTAADTALYYCARDSRYRSGWYDAFDIWGQGTMVTVSS
SEQ ID NO: 452

13875_HC [hu anti-<huCDH19> 16C1.1 VH]
QVQLQESGPGLVKPSETLSLTCTVSGGSISGYYWSWIRQPPGKGLEWIGYIYYIGSTNYNPSLKSRVTMS

IDTSKNQFSLTLSSLTAADTAVYFCARDGSSGWYRWFDPWGQGTLVTVSS
SEQ ID NO: 453

13876_HC [hu anti-<huCDH19> 16A4.1 VH]
QVQLQESGPGLAKPSETLSLTCTVSGDSITSYYWSWIRQPPGKGLEWIGYIYYSGSTNYNPSLKSRVTISV

DTSKNQFSLKLSSVTAADTAVYYCARDQRRIAAAGTHFYGMDVWGQGTTVTVSS
SEQ ID NO: 454

13877_HC [hu anti-<huCDH19> 22G10.1 VH]
EVQLLESGGGLVQPGGSLRLSCAASGFTFSSYAMNWVRQAPGKGLEWVSTISGGGANTYYADSVKGR

FTISSDNSKSTLYLQMNSLRAADTAVYHCAKGGMGGYYYGMDVWGQGTTVTVSS
SEQ ID NO: 455

13878_HC [hu anti-<huCDH19> 20D3.1 VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLWLHFDYWGQGTLVTVSS
SEQ ID NO: 456

13879_HC [hu anti-<huCDH19> 22D1.1 VH]
QVQLVQSGAEVKKPGASVRVSCKVSGYTFTSYFIHWVRQAPGQGLEWMGIINPISVSTSYAQKFQGRV

TMTRDTSTSTVFMELSSLRSEDTAVYYCARGGIQLWLHLDYWGQGTLVTVSS
SEQ ID NO: 457

13880_HC [hu anti-<huCDH19> 25F8.1 VH]
QVQLVQSGAEVKKPGASVKVSCKASGYTFTSYYTHWVRQAPGQGLEWMGIINPSGGSTRYAQKFQGR

VTMTRDTSTSTVFMELSSLRSEDTAVYYCARGGIQLWLHFDYWGQGTLVTVSS
SEQ ID NO: 458

13881_HC [hu anti-<huCDH19> 26F12.1 VH]
QVQLVQSGAEVKKPGASVKVSCKASRYTFTNYYMSWVRQAPGQGLEWMGIINPSGGDSYAQKFQG

RLTMTGDTSTSTVYMELSSLRSEDTAVYYCARGGIQLWLHFDYWGQGTLVTVSS
SEQ ID NO: 459

TABLE II-continued

13882_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR

VTMTGDTSTSTVYMELSSLRSEDTAVYYCARGGIKLWLHFDYWGQGTLVTVSS
SEQ ID NO: 460

13883_HC [hu anti-<huCDH19> 25G10.1 VH]
QVQLQESGPGLVKPSETLSLTCTVSGGSISGYYWSWIRQPPGKGLEWIGYIYYIGSTNYNPSLKSRVTMS

VDTSKNQFSLKLSSVTAADTAVYYCARDGSSGWYRWFDPWGQGTLVTVSS
SEQ ID NO: 461

13885_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLWLHLDYWGQGTLVTVSS
SEQ ID NO: 462

14022_HC [hu anti-< huCDH19> 4A2 VH]
QVQLQESGPGLVKPSQTLSLTCTVSGGSISSSGYYWSWIRQHPGKGLEWIGYIYYTGSAYYNPSLKSRV

TISVDTSKNQFSLKLSSVTAADTAVYYCARDGSSGWYFQYWGQGTLVTVSS
SEQ ID NO: 463

14024_HC [hu anti-<huCDH19> 4A2 (1-472)(Q17E,H47P) VH]
QVQLQESGPGLVKPSETLSLTCTVSGGSISSSGYYWSWIRQPPGKGLEWIGYIYYTGSAYYNPSLKSRVT

ISVDTSKNQFSLKLSSVTAADTAVYYCARDGSSGWYFQYWGQGTLVTVSS
SEQ ID NO: 464

14025_HC [hu anti-<huCDH19> 4A2 VH]
QVQLQESGPGLVKPSQTLSLTCTVSGGSISSSGYYWSWIRQHPGKGLEWIGYIYYTGSAYYNPSLKSRV

TISVDTSKNQFSLKLSSVTAADTAVYYCARDGSSGWYFQYWGQGTLVTVSS
SEQ ID NO: 465

14026_HC [hu anti-<huCDH19> 4A2 (1-472)(Q17E,H47P) VH]
QVQLQESGPGLVKPSETLSLTCTVSGGSISSSGYYWSWIRQPPGKGLEWIGYIYYTGSAYYNPSLKSRVT

ISVDTSKNQFSLKLSSVTAADTAVYYCARDGSSGWYFQYWGQGTLVTVSS
SEQ ID NO: 466

14027_HC [hu anti-<huCDH19> 4A2 (1-472)(Q17E,H47P,D111E) VH]
QVQLQESGPGLVKPSETLSLTCTVSGGSISSSGYYWSWIRQPPGKGLEWIGYIYYTGSAYYNPSLKSRVT

ISVDTSKNQFSLKLSSVTAADTAVYYCAREGSSGWYFQYWGQGTLVTVSS
SEQ ID NO: 467

14028_HC [hu anti-<huCDH19> 4A2 (1-472)(Q17E,H47P,D111E,W134Y) VH]
QVQLQESGPGLVKPSETLSLTCTVSGGSISSSGYYWSWIRQPPGKGLEWIGYIYYTGSAYYNPSLKSRVT

ISVDTSKNQFSLKLSSVTAADTAVYYCAREGSSGYYFQYWGQGTLVTVSS
SEQ ID NO: 468

14029_HC [hu anti-<huCDH19> 4A2 VH]
QVQLQESGPGLVKPSQTLSLTCTVSGGSISSSGYYWSWIRQHPGKGLEWIGYIYYTGSAYYNPSLKSRV

TISVDTSKNQFSLKLSSVTAADTAVYYCARDGSSGWYFQYWGQGTLVTVSS
SEQ ID NO: 469

14030_HC [hu anti-<huCDH19> 4F3 (1-471)(R17G) VH]
QVQLVESGGGVVQPGGSLRLSCAASGFSFSSYDMDWVRQTPGKGLEWVAVIWYDGSNKYYADSVRG

RFTISRDNSKNTLFLQMNSLRVEDTAVYYCARETGEGWYFDLWGRGTLVTVSS
SEQ ID NO: 470

14031_HC [hu anti-<huCDH19> 4F3 (1-471)(R17G,T47A) VH]
QVQLVESGGGVVQPGGSLRLSCAASGFSFSSYDMDWVRQAPGKGLEWVAVIWYDGSNKYYADSVRG

RFTISRDNSKNTLFLQMNSLRVEDTAVYYCARETGEGWYFDLWGRGTLVTVSS
SEQ ID NO: 471

14032_HC [hu anti-<huCDH19> 4F3 (1-471)(R17G,T47A,R141Q) VH]
QVQLVESGGGVVQPGGSLRLSCAASGFSFSSYDMDWVRQAPGKGLEWVAVIWYDGSNKYYADSVRG

RFTISRDNSKNTLFLQMNSLRVEDTAVYYCARETGEGWYFDLWGQGTLVTVSS
SEQ ID NO: 472

TABLE II-continued

14033_HC [hu anti-<huCDH19> 4F3 (1-471)(R17G,T47A,D61E,D72E,R141Q) VH]
QVQLVESGGGVVQPGGSLRLSCAASGFSFSSYDMDWVRQAPGKGLEWVAVIWYEGSNKYYAESVRG

RFTISRDNSKNTLFLQMNSLRVEDTAVYYCARETGEGWYFDLWGQGTLVTVSS
SEQ ID NO: 473

14034_HC [hu anti-<huCDH19> 4F3
(1-471)(R17G,T47A,D61E,D72E,W134Y,R141Q) VH]
QVQLVESGGGVVQPGGSLRLSCAASGFSFSSYDMDWVRQAPGKGLEWVAVIWYEGSNKYYAESVRG

RFTISRDNSKNTLFLQMNSLRVEDTAVYYCARETGEGYYFDLWGQGTLVTVSS
SEQ ID NO: 474

14039_HC [hu anti-<huCDH19> 2G6 (1-477)(R17G,D61E,D72E,K94N) VH]
QVQLVESGGGVVQPGGSLRLSCAASGFTFSSYGMHWVRQAPGKGLEWVAFIWYEGSNKYYAESVKD

RFTISRDNSKNTLYLQMNSLRAEDTAVYYCARRAGIIGTIGYYYGMDVWGQGTTVTVSS
SEQ ID NO: 475

14040_HC [hu anti-<huCDH19> 16C1.1 VH]
QVQLQESGPGLVKPSETLSLTCTVSGGSISGYYWSWIRQPPGKGLEWIGYIYYIGSTNYNPSLKSRVTMS

IDTSKNQFSLTLSSLTAADTAVYFCARDGSSGWYRWFDPWGQGTLVTVSS
SEQ ID NO: 476

14041_HC [hu anti-<huCDH19> 16C1.1 (1-469)(T92K) VH]
QVQLQESGPGLVKPSETLSLTCTVSGGSISGYYWSWIRQPPGKGLEWIGYIYYIGSTNYNPSLKSRVTMS

IDTSKNQFSLKLSSLTAADTAVYFCARDGSSGWYRWFDPWGQGTLVTVSS
SEQ ID NO: 477

14042_HC [hu anti-<huCDH19> 16C1.1 (1-469)(T92K,D109E) VH]
QVQLQESGPGLVKPSETLSLTCTVSGGSISGYYWSWIRQPPGKGLEWIGYIYYIGSTNYNPSLKSRVTMS

IDTSKNQFSLKLSSLTAADTAVYFCAREGSSGWYRWFDPWGQGTLVTVSS
SEQ ID NO: 478

14043_HC [hu anti-<huCDH19> 16C1.1 (1-469)(T92K,W132Y,W135Y) VH]
QVQLQESGPGLVKPSETLSLTCTVSGGSISGYYWSWIRQPPGKGLEWIGYIYYIGSTNYNPSLKSRVTMS

IDTSKNQFSLKLSSLTAADTAVYFCARDGSSGYYRYFDPWGQGTLVTVSS
SEQ ID NO: 479

14044_HC [hu anti-<huCDH19> 16C1.1 (1-469)(T92K) VH]
QVQLQESGPGLVKPSETLSLTCTVSGGSISGYYWSWIRQPPGKGLEWIGYIYYIGSTNYNPSLKSRVTMS

IDTSKNQFSLKLSSLTAADTAVYFCARDGSSGWYRWFDPWGQGTLVTVSS
SEQ ID NO: 480

14045_HC [hu anti-<huCDH19> 17H8.2 VH]
QVQLQESGPGLVKPSETLSLTCTVSGGSINSYYWSWIRQPPGKGLEWIGYIYYIGSTNYNPSLKSRVTISV

DTSKNQFSLKLSSVTAADTALYYCARDSRYRSGWYDAFDIWGQGTMVTVSS
SEQ ID NO: 481

14046_HC [hu anti-<huCDH19> 17H8.2 (1-471)(D109E) VH]
QVQLQESGPGLVKPSETLSLTCTVSGGSINSYYWSWIRQPPGKGLEWIGYIYYIGSTNYNPSLKSRVTISV

DTSKNQFSLKLSSVTAADTALYYCARESRYRSGWYDAFDIWGQGTMVTVSS
SEQ ID NO: 482

14047_HC [hu anti-<huCDH19> 17H8.2 (1-471)(D109E,W132Y) VH]
QVQLQESGPGLVKPSETLSLTCTVSGGSINSYYWSWIRQPPGKGLEWIGYIYYIGSTNYNPSLKSRVTISV

DTSKNQFSLKLSSVTAADTALYYCARESRYRSGYYDAFDIWGQGTMVTVSS
SEQ ID NO: 483

14048_HC [hu anti-<huCDH19> 17H8.2 (1-471)(D109E) VH]
QVQLQESGPGLVKPSETLSLTCTVSGGSINSYYWSWIRQPPGKGLEWIGYIYYIGSTNYNPSLKSRVTISV

DTSKNQFSLKLSSVTAADTALYYCARESRYRSGWYDAFDIWGQGTMVTVSS
SEQ ID NO: 484

14049_HC [hu anti-<huCDH19> 4F7 VH]
QVQLQESGPGLVKPSETLSLTCTVSGGSISSYSWSWIRQPPGKGLEWIGYIYYSGSTNYNPSLKSRVTISL

DTSKNQFSLKLSSVTAADTAVYYCARNWAFHFDYWGQGTLVTVSS
SEQ ID NO: 485

TABLE II-continued

14050_HC [hu anti-<huCDH19> 4F7 VH]
QVQLQESGPGLVKPSETLSLTCTVSGGSISSYSWSWIRQPPGKGLEWIGYIYYSGSTNYNPSLKSRVTISL

DTSKNQFSLKLSSVTAADTAVYYCARNWAFHFDYWGQGTLVTVSS
SEQ ID NO: 486

14051_HC [hu anti-<huCDH19> 4F7 (1-468)(W113Y) VH]
QVQLQESGPGLVKPSETLSLTCTVSGGSISSYSWSWIRQPPGKGLEWIGYIYYSGSTNYNPSLKSRVTISL

DTSKNQFSLKLSSVTAADTAVYYCARNYAFHFDYWGQGTLVTVSS
SEQ ID NO: 487

14052_HC [hu anti-<huCDH19> 4B10 (1-471)(R17G,D61E,D72E,W134Y) VH]
QVQLVESGGGVVQPGGSLRLSCAASGFTFSSYDMHWVRQAPGKGLEWVAVISYEGTNEYYAESVKGR

FTISRDTSKNTLYLQMNSLRAEDTAVYYCARERYFDYSFDYWGQGTLVSVSS
SEQ ID NO: 488

14053_HC [hu anti-<huCDH19> 4B10 VH]
QVQLVESGGGVVQPGRSLRLSCAASGFTFSSYDMHWVRQAPGKGLEWVAVISYDGTNEYYADSVKGR

FTISRDTSKNTLYLQMNSLRAEDTAVYYCARERYFDWSFDYWGQGTLVSVSS
SEQ ID NO: 489

14054_HC [hu anti-<huCDH19> 4B10 (1-471)(R17G) VH]
QVQLVESGGGVVQPGGSLRLSCAASGFTFSSYDMHWVRQAPGKGLEWVAVISYDGTNEYYADSVKG

RFTISRDTSKNTLYLQMNSLRAEDTAVYYCARERYFDWSFDYWGQGTLVSVSS
SEQ ID NO: 490

14055_HC [hu anti-<huCDH19> 4B10 (1-471)(R17G,D61E,D72E) VH]
QVQLVESGGGVVQPGGSLRLSCAASGFTFSSYDMHWVRQAPGKGLEWVAVISYEGTNEYYAESVKGR

FTISRDTSKNTLYLQMNSLRAEDTAVYYCARERYFDWSFDYWGQGTLVSVSS
SEQ ID NO: 491

14056_HC [hu anti-<huCDH19> 4A9 VH]
QVQLQESGPGLVKPSETLSLTCTVSGGSISGYYWSWIRQPPGKGLEWFAYFSYSGSTNYNPSLKSRVTLS

VDTSKNQFSLKLSSVTAADTAVYYCARNWAFHFDFWGQGTLVTVSS
SEQ ID NO: 492

14057_HC [hu anti-<huCDH19> 4A9 (1-468)(F55I,A56G) VH]
QVQLQESGPGLVKPSETLSLTCTVSGGSISGYYWSWIRQPPGKGLEWIGYFSYSGSTNYNPSLKSRVTLS

VDTSKNQFSLKLSSVTAADTAVYYCARNWAFHFDFWGQGTLVTVSS
SEQ ID NO: 493

14058_HC [hu anti-<huCDH19> 4A9 (1-468)(F55I,A56G) VH]
QVQLQESGPGLVKPSETLSLTCTVSGGSISGYYWSWIRQPPGKGLEWIGYFSYSGSTNYNPSLKSRVTLS

VDTSKNQFSLKLSSVTAADTAVYYCARNWAFHFDFWGQGTLVTVSS
SEQ ID NO: 494

14059_HC [hu anti-<huCDH19> 4A9 (1-468)(F55I,A56G,W113Y) VH]
QVQLQESGPGLVKPSETLSLTCTVSGGSISGYYWSWIRQPPGKGLEWIGYFSYSGSTNYNPSLKSRVTLS

VDTSKNQFSLKLSSVTAADTAVYYCARNYAFHFDFWGQGTLVTVSS
SEQ ID NO: 495

14060_HC [hu anti-<huCDH19> 20D3.1 VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLWLHFDYWGQGTLVTVSS
SEQ ID NO: 496

14061_HC [hu anti-<huCDH19> 20D3.1 VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLWLHFDYWGQGTLVTVSS
SEQ ID NO: 497

14062_HC [hu anti-<huCDH19> 20D3.1 (1-469)(W133Y) VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLYLHFDYWGQGTLVTVSS
SEQ ID NO: 498

TABLE II-continued

14063_HC [hu anti-<huCDH19> 20D3.1 (1-469)(W133Y) VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLYLHFDYWGQGTLVTVSS
SEQ ID NO: 499

14064_HC [hu anti-<huCDH19> 20D3.1 (1-469)(W133Y) VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLYLHFDYWGQGTLVTVSS
SEQ ID NO: 500

14065_HC [hu anti-<huCDH19> 22G10.1 (1-470)(S82R,A99E) VH]
EVQLLESGGGLVQPGGSLRLSCAASGFTFSSYAMNWVRQAPGKGLEWVSTISGGGANTYYADSVKGR

FTISRDNSKSTLYLQMNSLRAEDTAVYHCAKGGMGGYYYGMDVWGQGTTVTVSS
SEQ ID NO: 501

14066_HC [hu anti-<huCDH19> 22G10.1 (1-470)(A99E,H105Y) VH]
EVQLLESGGGLVQPGGSLRLSCAASGFTFSSYAMNWVRQAPGKGLEWVSTISGGGANTYYADSVKGR

FTISSDNSKSTLYLQMNSLRAEDTAVYYCAKGGMGGYYYGMDVWGQGTTVTVSS
SEQ ID NO: 502

14067_HC [hu anti-<huCDH19> 22G10.1 (1-470)(A99E) VH]
EVQLLESGGGLVQPGGSLRLSCAASGFTFSSYAMNWVRQAPGKGLEWVSTISGGGANTYYADSVKGR

FTISSDNSKSTLYLQMNSLRAEDTAVYHCAKGGMGGYYYGMDVWGQGTTVTVSS
SEQ ID NO: 503

14068_HC [hu anti-<huCDH19> 22G10.1 (1-470)(A99E) VH]
EVQLLESGGGLVQPGGSLRLSCAASGFTFSSYAMNWVRQAPGKGLEWVSTISGGGANTYYADSVKGR

FTISSDNSKSTLYLQMNSLRAEDTAVYHCAKGGMGGYYYGMDVWGQGTTVTVSS
SEQ ID NO: 504

14069_HC [hu anti-<huCDH19> 22G10.1 (1-470)(D72E,A99E) VH]
EVQLLESGGGLVQPGGSLRLSCAASGFTFSSYAMNWVRQAPGKGLEWVSTISGGGANTYYAESVKGRF

TISSDNSKSTLYLQMNSLRAEDTAVYHCAKGGMGGYYYGMDVWGQGTTVTVSS
SEQ ID NO: 505

14070_HC [hu anti-<huCDH19> 22G10.1 (1-470)(H105Y) VH]
EVQLLESGGGLVQPGGSLRLSCAASGFTFSSYAMNWVRQAPGKGLEWVSTISGGGANTYYADSVKGR

FTISSDNSKSTLYLQMNSLRAADTAVYYCAKGGMGGYYYGMDVWGQGTTVTVSS
SEQ ID NO: 506

14071_HC [hu anti-<huCDH19> 16A4.1 (1-474)(T144L) VH]
QVQLQESGPGLAKPSETLSLTCTVSGDSITSYYWSWIRQPPGKGLEWIGYIYYSGSTNYNPSLKSRVTISV

DTSKNQFSLKLSSVTAADTAVYYCARDQRRIAAAGTHFYGMDVWGQGTLVTVSS
SEQ ID NO: 507

14072_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLWLHLDYWGQGTLVTVSS
SEQ ID NO: 508

14073_HC [hu anti-<huCDH19> 19B5.1 (1-469)(W133Y) VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLYLHLDYWGQGTLVTVSS
SEQ ID NO: 509

14074_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLWLHLDYWGQGTLVTVSS
SEQ ID NO: 510

14075_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLWLHLDYWGQGTLVTVSS
SEQ ID NO: 511

TABLE II-continued

14076_HC [hu anti-<huCDH19> 19B5.1
(1-469)(W133Y) VH]
QVQLVQSGAEVKKPGASVKVSCKVSGYTFTSYFIHWVRQAPGQGLEWMGIINPISVSTSYAQKFQGRV

TMTRDTSTSTVFMELSSLRSEDTAVYYCARGGIQLYLHLDYWGQGTLVTVSS
SEQ ID NO: 512

14077_HC [hu anti-<huCDH19> 23A10.3 (1-474)(L92Q) VH]
QVQLVESGGGVVQPGRSLRLSCAASGFTFSRYGIHWVRQAPGKGLEWVAVIWYDGSNKYYADSVKGR

FTISRDNSKNTLYLQMNSLRAEDSAVYYCARRAGIPGTTGYYYGMDVWGQGTTVTVSS
SEQ ID NO: 513

14078_HC [hu anti-<huCDH19> 23A10.3 (1-474)(R17G,L92Q) VH]
QVQLVESGGGVVQPGGSLRLSCAASGFTFSRYGIHWVRQAPGKGLEWVAVIWYDGSNKYYADSVKG

RFTISRDNSKNTLYLQMNSLRAEDSAVYYCARRAGIPGTTGYYYGMDVWGQGTTVTVSS
SEQ ID NO: 514

14079_HC [hu anti-<huCDH19> 23A10.3 (1-474)(R17G,D61E,D72E,L92Q) VH]
QVQLVESGGGVVQPGGSLRLSCAASGFTFSRYGIHWVRQAPGKGLEWVAVIWYEGSNKYYAESVKGR

FTISRDNSKNTLYLQMNSLRAEDSAVYYCARRAGIPGTTGYYYGMDVWGQGTTVTVSS
SEQ ID NO: 515

14080_HC [hu anti-<huCDH19> 23A10.3 VH]
QVQLVESGGGVVQPGRSLRLSCAASGFTFSRYGIHWVRQAPGKGLEWVAVIWYDGSNKYYADSVKGR

FTISRDNSKNTLYLLMNSLRAEDSAVYYCARRAGIPGTTGYYYGMDVWGQGTTVTVSS
SEQ ID NO: 516

14081_HC [hu anti-<huCDH19> 25G10.1 VH]
QVQLQESGPGLVKPSETLSLTCTVSGGSISGYYWSWIRQPPGKGLEWIGYIYYIGSTNYNPSLKSRVTMS

VDTSKNQFSLKLSSVTAADTAVYYCARDGSSGWYRWFDPWGQGTLVTVSS
SEQ ID NO: 517

14082_HC [hu anti-<huCDH19> 25G10.1 (1-469)(D109E,W132Y,W135Y) VH]
QVQLQESGPGLVKPSETLSLTCTVSGGSISGYYWSWIRQPPGKGLEWIGYIYYIGSTNYNPSLKSRVTMS

VDTSKNQFSLKLSSVTAADTAVYYCAREGSSGYYRYFDPWGQGTLVTVSS
SEQ ID NO: 518

14083_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR

VTMTGDTSTSTVYMELSSLRSEDTAVYYCARGGIKLWLHFDYWGQGTLVTVSS
SEQ ID NO: 519

14084_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR

VTMTGDTSTSTVYMELSSLRSEDTAVYYCARGGIKLWLHFDYWGQGTLVTVSS
SEQ ID NO: 520

14085_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR

VTMTGDTSTSTVYMELSSLRSEDTAVYYCARGGIKLWLHFDYWGQGTLVTVSS
SEQ ID NO: 521

14086_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR

VTMTGDTSTSTVYMELSSLRSEDTAVYYCARGGIKLWLHFDYWGQGTLVTVSS
SEQ ID NO: 522

14087_HC [hu anti-<huCDH19> 26D1.1 (1-469)(W133Y) VH]
QVQLVQSGAEVKKPGASVKVSCKASRYTFTSYYMSWVRQAPGQGLEWMGIIHPSGGDTTYAQKFQGR

VTMTGDTSTSTVYMELSSLRSEDTAVYYCARGGIKLYLHFDYWGQGTLVTVSS
SEQ ID NO: 523

14088_HC [hu anti-<huCDH19> 26D1.1 (1-469)(R27G,G82R) VH]
QVQLVQSGAEVKKPGASVKVSCKASGYTFTSYYMSWVRQAPGQGLEWMGIIHPSGGDTTYAQKFQGR

VTMTRDTSTSTVYMELSSLRSEDTAVYYCARGGIKLWLHFDYWGQGTLVTVSS
SEQ ID NO: 524

TABLE II-continued

14089_HC [hu anti-<huCDH19> 26F12.1 VH]
QVQLVQSGAEVKKPGASVKVSCKASRYTFTNYYMSWVRQAPGQGLEWMGIINPSGGDSTYAQKFQG

RLTMTGDTSTSTVYMELSSLRSEDTAVYYCARGGIQLWLHFDYWGQGTLVTVSS
SEQ ID NO: 525

14090_HC [hu anti-<huCDH19> 26F12.1 VH]
QVQLVQSGAEVKKPGASVKVSCKASRYTFTNYYMSWVRQAPGQGLEWMGIINPSGGDSTYAQKFQG

RLTMTGDTSTSTVYMELSSLRSEDTAVYYCARGGIQLWLHFDYWGQGTLVTVSS
SEQ ID NO: 526

14091_HC [hu anti-<huCDH19> 26F12.1 (1-469)(W133Y) VH]
QVQLVQSGAEVKKPGASVKVSCKASRYTFTNYYMSWVRQAPGQGLEWMGIINPSGGDSTYAQKFQG

RLTMTGDTSTSTVYMELSSLRSEDTAVYYCARGGIQLYLHFDYWGQGTLVTVSS
SEQ ID NO: 527

14092_HC [hu anti-<huCDH19> 26F12.1 (1-469)(W133Y) VH]
QVQLVQSGAEVKKPGASVKVSCKASRYTFTNYYMSWVRQAPGQGLEWMGIINPSGGDSTYAQKFQG

RLTMTGDTSTSTVYMELSSLRSEDTAVYYCARGGIQLYLHFDYWGQGTLVTVSS
SEQ ID NO: 528

14093_HC [hu anti-<huCDH19> 25F8.1 VH]
QVQLVQSGAEVKKPGASVKVSCKASGYTFTSYYIHWVRQAPGQGLEWMGIINPSGGSTRYAQKFQGR

VTMTRDTSTSTVFMELSSLRSEDTAVYYCARGGIQLWLHFDYWGQGTLVTVSS
SEQ ID NO: 529

14094_HC [hu anti-<huCDH19> 25F8.1 VH]
QVQLVQSGAEVKKPGASVKVSCKASGYTFTSYYIHWVRQAPGQGLEWMGIINPSGGSTRYAQKFQGR

VTMTRDTSTSTVFMELSSLRSEDTAVYYCARGGIQLWLHFDYWGQGTLVTVSS
SEQ ID NO: 530

14095_HC [hu anti-<huCDH19> 25F8.1 (1-469)(F90Y) VH]
QVQLVQSGAEVKKPGASVKVSCKASGYTFTSYYIHWVRQAPGQGLEWMGIINPSGGSTRYAQKFQGR

VTMTRDTSTSTVYMELSSLRSEDTAVYYCARGGIQLWLHFDYWGQGTLVTVSS
SEQ ID NO: 531

14096_HC [hu anti-<huCDH19> 25F8.1 (1-469)(F90Y) VH]
QVQLVQSGAEVKKPGASVKVSCKASGYTFTSYYIHWVRQAPGQGLEWMGIINPSGGSTRYAQKFQGR

VTMTRDTSTSTVYMELSSLRSEDTAVYYCARGGIQLWLHFDYWGQGTLVTVSS
SEQ ID NO: 532

14097_HC [hu anti-<huCDH19> 25F8.1 (1-469)(F90Y,W133Y) VH]
QVQLVQSGAEVKKPGASVKVSCKASGYTFTSYYIHWVRQAPGQGLEWMGIINPSGGSTRYAQKFQGR

VTMTRDTSTSTVYMELSSLRSEDTAVYYCARGGIQLYLHFDYWGQGTLVTVSS
SEQ ID NO: 533

14098_HC [hu anti-<huCDH19> 22D1.1 VH]
QVQLVQSGAEVKKPGASVRVSCKVSGYTFTSYFIHWVRQAPGQGLEWMGIINPISVSTSYAQKFQGRV

TMTRDTSTSTVFMELSSLRSEDTAVYYCARGGIQLWLHLDYWGQGTLVTVSS
SEQ ID NO: 534

14099_HC [hu anti-<huCDH19> 22D1.1 VH]
QVQLVQSGAEVKKPGASVRVSCKVSGYTFTSYFIHWVRQAPGQGLEWMGIINPISVSTSYAQKFQGRV

TMTRDTSTSTVFMELSSLRSEDTAVYYCARGGIQLWLHLDYWGQGTLVTVSS
SEQ ID NO: 535

14100_HC [hu anti-<huCDH19> 22D1.1 (1-469)(W133Y) VH]
QVQLVQSGAEVKKPGASVRVSCKVSGYTFTSYFIHWVRQAPGQGLEWMGIINPISVSTSYAQKFQGRV

TMTRDTSTSTVFMELSSLRSEDTAVYYCARGGIQLYLHLDYWGQGTLVTVSS
SEQ ID NO: 536

14101_HC [hu anti-<huCDH19> 22D1.1 (1-469)(W133Y) VH]
QVQLVQSGAEVKKPGASVRVSCKVSGYTFTSYFIHWVRQAPGQGLEWMGIINPISVSTSYAQKFQGRV

TMTRDTSTSTVFMELSSLRSEDTAVYYCARGGIQLYLHLDYWGQGTLVTVSS
SEQ ID NO: 537

TABLE II-continued

14102_HC [hu anti-<huCDH19> 22D1.1 (1-469)(F90Y) VH]
QVQLVQSGAEVKKPGASVRVSCKVSGYTFTSYFIHWVRQAPGQGLEWMGIINPISVSTSYAQKFQGRV

TMTRDTSTSTVYMELSSLRSEDTAVYYCARGGIQLWLHLDYWGQGTLVTVSS
SEQ ID NO: 538

13591_HC [hu anti-<huCDH19> 4F7 VH]
QVQLQESGPGLVKPSETLSLTCTVSGGSISSYSWSWIRQPPGKGLEWIGYIYYSGSTNYNPSLKSRVTISL

DTSKNQFSLKLSSVTAADTAVYYCARNWAFHFDYWGQGTLVTVSS
SEQ ID NO: 539

14301_HC [hu anti-<huCDH19> 2G6 VH]
QVQLVESGGGVVQPGRSLRLSCAASGFTFSSYGMHWVRQAPGKGLEWVAFIWYDGSNKYYADSVKD

RFTISRDNSKNTLYLQMKSLRAEDTAVYYCARRAGIIGTIGYYYGMDVWGQGTTVTVSS
SEQ ID NO: 540

14302_HC [hu anti-<huCDH19> 2G6 (1-477)(R17G,K94N) VH]
QVQLVESGGGVVQPGGSLRLSCAASGFTFSSYGMHWVRQAPGKGLEWVAFIWYDGSNKYYADSVKD

RFTISRDNSKNTLYLQMNSLRAEDTAVYYCARRAGIIGTIGYYYGMDVWGQGTTVTVSS
SEQ ID NO: 541

14303_HC [hu anti-<huCDH19> 2G6 (1-477)(D61E,D72E) VH]
QVQLVESGGGVVQPGRSLRLSCAASGFTFSSYGMHWVRQAPGKGLEWVAFIWYEGSNKYYAESVKD

RFTISRDNSKNTLYLQMKSLRAEDTAVYYCARRAGIIGTIGYYYGMDVWGQGTTVTVSS
SEQ ID NO: 542

14304_HC [hu anti-<huCDH19> 2G6 (1-477)(R17G) VH]
QVQLVESGGGVVQPGGSLRLSCAASGFTFSSYGMHWVRQAPGKGLEWVAFIWYDGSNKYYADSVKD

RFTISRDNSKNTLYLQMKSLRAEDTAVYYCARRAGIIGTIGYYYGMDVWGQGTTVTVSS
SEQ ID NO: 543 d: Light Chain Variable Region Amino acid Sequences

13586_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD

FTLTISRLEPEDFAVYYCQQYGSSWTFGQGTKVEIKR
SEQ ID NO: 544

13589_LC [hu anti-<huCDH19> 4A9 VL]
QSVLTQPPSVSGAPGQRVTISCTGSSSNIGTGYAVHWYQQFPGTAPKLLIYGNNNRPSGVPDRFSGSKSG

TSASLAITGLQAEDEADYYCQSYDSRLSGWVFGGGTKLTVLG
SEQ ID NO: 545

13590_LC [hu anti-<huCDH19> 4B10 VL]
EIVLTQSPGTLSLSPGERATLSCRASQSVSNTYLAWYHQRPGQAPRLLIYGASSRATGIPDRFSGSGSGTD

FALTISSLEPEDFAVYYCQQYSNSWTFGQGTKVEIKR
SEQ ID NO: 546

13874_LC [hu anti-<huCDH19> 17H8.2 VL]
DIVLTQSPGTLSLSPGERATLSCRASQSVAGSYLAWYQQKPGQAPRLLISGASSRATGIPDRFSGSGSGT

DFTLTISRLEPEDFAVYYCQQYGKSPITFGQGTRLEMKG
SEQ ID NO: 547

13875_LC [hu anti-<huCDH19> 16C1.1 VL]
EIVLTQSPGTLSLSPGERATLSCRASQSVSSSYLAWYQQKPGQAPRLLIFGASSRATGIPDRFSGSGSGTD

FTLTISGLEPEDFAVYHCQQYGNSPLTFGGGTKVEIKR
SEQ ID NO: 548

13876_LC [hu anti-<huCDH19> 16A4.1 VL]
EIVLTQSPGTLSLSPGERATLSCRASQSVSSSYLAWYQQKPGQAPRLLIYGTSSRATGIPDRFSGSGSGTD

FTLTISRLEPEDFAVYYCQQYGSSPFTFGGGTKVEIKR
SEQ ID NO: 549

13877_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF

TLTISSLQSEDFAVYYCQQYNYWPLTFGGGTKVEIKR
SEQ ID NO: 552

TABLE II-continued

13878_LC [hu anti-<huCDH19> 20D3.1 VL]
QSALTQPPSATGTPGQRVTISCSGSSSNIGSNFVNWYKQLPGTAPKVLIYTNNQRPSGVPDRFSGSKSGTS

ASLAISGLQSEDESDYYCATWDDSLNGWVFGGGTKLTVLG
SEQ ID NO: 554

13879_LC [hu anti-<huCDH19> 22D1.1 VL]
QSALTQPPSATGTPGQRVTISCSGSSSNIGSNFVNWYKQLPGTAPKVLIYTNNQRPSGVPDRFSGSKSGTS

ASLAISGLQSEDESDYYCATWDDSMNGWVFGGGTKLTVLG
SEQ ID NO: 555

13880_LC [hu anti-<huCDH19> 25F8.1 VL]
QSALTQPPSATGTPGQRVTISCSGSSSNIGRNFVNWYKQLPGTAPKVLIYTNNQRPSGVPDRFSGSKSGT

SASLAISGLQSEDESDYYCAAWDDSLNGWVFGGGTKLTVLG
SEQ ID NO: 556

13881_LC [hu anti-<huCDH19> 26F12.1 VL]
QSVLTQSPSASGTPGQKVTISCSGSRSNIGSNFVNWYQQLPGTAPKLLIYTNYQRPSGVPDRFSGSKSGTS

ASLAISGLQSEDEADYYCAVWDDSLNGWVFGGGTKLTVLG
SEQ ID NO: 557

13882_LC [hu anti-<huCDH19> 26D1.1 VL]
HSVLTQSPSASGTPGQRVTISCSGSRSNIGSNFVNWYQQLPGTAPKLLIYTNNQRPSGVPDRFSGSKSGTS

ASLAISGLQSEDEADYYCAVWDDSLNGWVFGGGTKLTVLG
SEQ ID NO: 555

13883_LC [hu anti-<huCDH19> 25G10.1 VL]
EIVLTQSPGTLSLSPGERATLSCRASQSVSSSYLAWYQQKPGQAPRLLIFGASSRATGIPDRFSGSGSTD

FTLTISRLEPEDFAVYHCQQYGNSPLTFGGGTKVEIKR
SEQ ID NO: 556

13885_LC [hu anti-<huCDH19> 19B5.1 VL]
QSALTQPPSTTGTPGQRVTISCSGSRSNIGSNFVNWYKQLPGTAPKVLIYTNNQRPSGVPDRFSGSKSGTS

ASLAISGLQSEDESDYYCATWDDSMNGWVFGGGTKLTVLG
SEQ ID NO: 557

14022_LC [hu anti-<huCDH19> 4A2 (1-236)(N30Q) VL]
EIVLTQSPGTLSLSPGERATLSCRASRQISSSYLAWYQQKPGQAPRLLIYGPSSRATGIPDRFSGSGSGTDF

TLTISRLEPEDFTVYYCQQYGSSFTFGPGTKVDIKR
SEQ ID NO: 558

14024_LC [hu anti-<huCDH19> 4A2 (1-236)(N30Q,T102A,P141Q) VL]
EIVLTQSPGTLSLSPGERATLSCRASRQISSSYLAWYQQKPGQAPRLLIYGPSSRATGIPDRFSGSGSGTDF

TLTISRLEPEDFAVYYCQQYGSSFTFGPGTKVDIKR
SEQ ID NO: 559

14025_LC [hu anti-<huCDH19> 4A2 (1-236)(N30Q,T102A) VL]
EIVLTQSPGTLSLSPGERATLSCRASRQISSSYLAWYQQKPGQAPRLLIYGPSSRATGIPDRFSGSGSGTDF

TLTISRLEPEDFAVYYCQQYGSSFTFGPGTKVDIKR
SEQ ID NO: 560

14026_LC [hu anti-<huCDH19> 4A2 (1-236)(N30Q,T102A) VL]
EIVLTQSPGTLSLSPGERATLSCRASRQISSSYLAWYQQKPGQAPRLLIYGPSSRATGIPDRFSGSGSGTDF

TLTISRLEPEDFAVYYCQQYGSSFTFGPGTKVDIKR
SEQ ID NO: 561

14027_LC [hu anti-<huCDH19> 4A2 (1-236)(N30Q,T102A,P141Q) VL]
EIVLTQSPGTLSLSPGERATLSCRASRQISSSYLAWYQQKPGQAPRLLIYGPSSRATGIPDRFSGSGSGTDF

TLTISRLEPEDFAVYYCQQYGSSFTFGQGTKVDIKR
SEQ ID NO: 562

14028_LC [hu anti-<huCDH19> 4A2 (1-236)(N30Q,T102A,P141Q) VL]
EIVLTQSPGTLSLSPGERATLSCRASRQISSSYLAWYQQKPGQAPRLLIYGPSSRATGIPDRFSGSGSGTDF

TLTISRLEPEDFAVYYCQQYGSSFTFGQGTKVDIKR
SEQ ID NO: 563

TABLE II-continued

14029_LC [hu anti-<huCDH19> 4A2 (1-236)(R29Q,N30S) VL]
EIVLTQSPGTLSLSPGERATLSCRASQSISSSYLAWYQQKPGQAPRLLIYGPSSRATGIPDRFSGSGSGTDF

TLTISRLEPEDFTVYYCQQYGSSFTFGPGTKVDIKR
SEQ ID NO: 564

14030_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD

FTLTISRLEPEDFAVYYCQQYGSSWTFGQGTKVEIKR
SEQ ID NO: 565

14031_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD

FTLTISRLEPEDFAVYYCQQYGSSWTFGQGTKVEIKR
SEQ ID NO: 566

14032_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD

FTLTISRLEPEDFAVYYCQQYGSSWTFGQGTKVEIKR
SEQ ID NO: 567

14033_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD

FTLTISRLEPEDFAVYYCQQYGSSWTFGQGTKVEIKR
SEQ ID NO: 568

14034_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD

FTLTISRLEPEDFAVYYCQQYGSSWTFGQGTKVEIKR
SEQ ID NO: 569

14039_LC [hu anti-<huCDH19> 2G6 (1-234)(C42S,D110E) VL]
SYELTQPPSVSVSPGQTASITCSGDRLGEKYTSWYQQRPGQSPLLVIYQDTKRPSGIPERFSGSNSGNTAT

LTISGTQAMDEADYYCQAWESSTVVFGGGTKLTVLG
SEQ ID NO: 570

14040_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD

FTLTISGLEPEDFAVYYCQQYGNSPLTFGGGTKVEIKR
SEQ ID NO: 571

14041_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD

FTLTISGLEPEDFAVYYCQQYGNSPLTFGGGTKVEIKR
SEQ ID NO: 572

14042_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD

FTLTISGLEPEDFAVYYCQQYGNSPLTFGGGTKVEIKR
SEQ ID NO: 573

14043_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD

FTLTISGLEPEDFAVYYCQQYGNSPLTFGGGTKVEIKR
SEQ ID NO: 574

14044_LC [hu anti-<huCDH19> 16C1.1 (1-235)(G95R,H105Y,G141Q) VL]
EIVLTQSPGTLSLSPGERATLSCRASQSVSSSYLAWYQQKPGQAPRLLIFGASSRATGIPDRFSGSGSGTD

FTLTISRLEPEDFAVYYCQQYGNSPLTFGQGTKVEIKR
SEQ ID NO: 575

14045_LC [hu anti-<huCDH19> 17H8.2 (1-235)(G149R) VL]
DIVLTQSPGTLSLSPGERATLSCRASQSVAGSYLAWYQQKPGQAPRLLISGASSRATGIPDRFSGSGSGT

DFTLTISRLEPEDFAVYYCQQYGKSPITFGQGTRLEMKR
SEQ ID NO: 576

TABLE II-continued

14046_LC [hu anti-<huCDH19> 17H8.2 (1-235)(G149R) VL]
DIVLTQSPGTLSLSPGERATLSCRASQSVAGSYLAWYQQKPGQAPRLLISGASSRATGIPDRFSGSGSGT

DFTLTISRLEPEDFAVYYCQQYGKSPITFGQGTRLEMKR
SEQ ID NO: 577

14047_LC [hu anti-<huCDH19> 17H8.2 (1-235)(G149R) VL]
DIVLTQSPGTLSLSPGERATLSCRASQSVAGSYLAWYQQKPGQAPRLLISGASSRATGIPDRFSGSGSGT

DFTLTISRLEPEDFAVYYCQQYGKSPITFGQGTRLEMKR
SEQ ID NO: 578

14048_LC [hu anti-<huCDH19> 17H8.2 (1-235)(S57Y,G149R) VL]
DIVLTQSPGTLSLSPGERATLSCRASQSVAGSYLAWYQQKPGQAPRLLIYGASSRATGIPDRFSGSGSGT

DFTLTISRLEPEDFAVYYCQQYGKSPITFGQGTRLEMKR
SEQ ID NO: 579

14049_LC [hu anti-<huCDH19> 4F7 (1-239)(H57Y) VL]
QSVLTQPPSVSGAPGQRVTISCTGSSSNIGTGYDVHWYQQLPGTAPKLLIYGNSNRPSGVPDRFSGSKSG

TSASLAITGLQAEDEADYYCQSYDSSLSGWVFGGGTRLTVLG
SEQ ID NO: 580

14050_LC [hu anti-<huCDH19> 4F7 (1-239)(H57Y,D110E) VL]
QSVLTQPPSVSGAPGQRVTISCTGSSSNIGTGYDVHWYQQLPGTAPKLLIYGNSNRPSGVPDRFSGSKSG

TSASLAITGLQAEDEADYYCQSYESSLSGWVFGGGTRLTVLG
SEQ ID NO: 581

14051_LC [hu anti-<huCDH19> 4F7 (1-239)(D110E) VL]
QSVLTQPPSVSGAPGQRVTISCTGSSSNIGTGYDVHWYQQLPGTAPKLLIHGNSNRPSGVPDRFSGSKSG

TSASLAITGLQAEDEADYYCQSYESSLSGWVFGGGTRLTVLG
SEQ ID NO: 582

14052_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD

FTLTISSLEPEDFAVYYCQQYSNSWTFGQGTKVEIKR
SEQ ID NO: 583

14053_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD

FTLTISSLEPEDFAVYYCQQYSNSWTFGQGTKVEIKR
SEQ ID NO: 584

14054_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD

FTLTISSLEPEDFAVYYCQQYSNSWTFGQGTKVEIKR
SEQ ID NO: 585

14055_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD

FTLTISSLEPEDFAVYYCQQYSNSWTFGQGTKVEIKR
SEQ ID NO: 586

14056_LC [hu anti-<huCDH19> 4A9 (1-239)(F47L) VL]
QSVLTQPPSVSGAPGQRVTISCTGSSSNIGTGYAVHWYQQLPGTAPKLLIYGNNNRPSGVPDRFSGSKSG

TSASLAITGLQAEDEADYYCQSYDSRLSGWVFGGGTKLTVLG
SEQ ID NO: 587

14057_LC [hu anti-<huCDH19> 4A9 (1-239)(F47L) VL]
QSVLTQPPSVSGAPGQRVTISCTGSSSNIGTGYAVHWYQQLPGTAPKLLIYGNNNRPSGVPDRFSGSKSG

TSASLAITGLQAEDEADYYCQSYDSRLSGWVFGGGTKLTVLG
SEQ ID NO: 588

14058_LC [hu anti-<huCDH19> 4A9 (1-239)(F47L,D110E) VL]
QSVLTQPPSVSGAPGQRVTISCTGSSSNIGTGYAVHWYQQLPGTAPKLLIYGNNNRPSGVPDRFSGSKSG

TSASLAITGLQAEDEADYYCQSYESRLSGWVFGGGTKLTVLG
SEQ ID NO: 589

TABLE II-continued

14059_LC [hu anti-<huCDH19> 4A9 (1-239)(F47L,D110E) VL]
QSVLTQPPSVSGAPGQRVTISCTGSSSNIGTGYAVHWYQQLPGTAPKLLIYGNNNRPSGVPDRFSGSKSG

TSASLAITGLQAEDEADYYCQSYESRLSGWVFGGGTKLTVLG
SEQ ID NO: 590

14060_LC [hu anti-<huCDH19> 20D3.1 (1-235)(S102A) VL]
QSALTQPPSATGTPGQRVTISCSGSSSNIGSNFVNWYKQLPGTAPKVLIYTNNQRPSGVPDRFSGSKSGTS

ASLAISGLQSEDEADYYCATWDDSLNGWVFGGGTKLTVLG
SEQ ID NO: 591

14061_LC [hu anti-<huCDH19> 20D3.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATWDDSLNGWVFGGGTKLTVLG
SEQ ID NO: 592

14062_LC [hu anti-<huCDH19> 20D3.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATWDDSLNGWVFGGGTKLTVLG
SEQ ID NO: 593

14063_LC [hu anti-<huCDH19> 20D3.1 (1-235)(K45Q,S102A,D111E,N135Q) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATWDESLQGWVFGGGTKLTVLG
SEQ ID NO: 594

14064_LC [hu anti-<huCDH19> 20D3.1 (1-235)(W109Y) VL]
QSALTQPPSATGTPGQRVTISCSGSSSNIGSNFVNWYKQLPGTAPKVLIYTNNQRPSGVPDRFSGSKSGTS

ASLAISGLQSEDESDYYCATYDDSLNGWVFGGGTKLTVLG
SEQ ID NO: 595

14065_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF

TLTISSLQSEDFAVYYCQQYNYWPLTFGGGTKVEIKR
SEQ ID NO: 596

14066_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF

TLTISSLQSEDFAVYYCQQYNYWPLTFGGGTKVEIKR
SEQ ID NO: 597

14067_LC [hu anti-<huCDH19> 22G10.1 (1-234)(Q97E,S98P) VL]
EIVMTQSPVTLSLSLGERATLSCRASQSISSNLAWFQQKPGQAPRLLIYGAFTRATGIPARVSGSGSGTEF

TLTISSLEPEDFAVYYCQQYNYWPLTFGGGTKVEIKR
SEQ ID NO: 598

14068_LC [hu anti-<huCDH19> 22G10.1 (1-234)(V78F,Q97E,S98P) VL]
EIVMTQSPVTLSLSLGERATLSCRASQSISSNLAWFQQKPGQAPRLLIYGAFTRATGIPARFSGSGSGTEF

TLTISSLEPEDFAVYYCQQYNYWPLTFGGGTKVEIKR
SEQ ID NO: 599

14069_LC [hu anti-<huCDH19> 22G10.1 (1-234)(V78F,Q97E,S98P) VL]
EIVMTQSPVTLSLSLGERATLSCRASQSISSNLAWFQQKPGQAPRLLIYGAFTRATGIPARFSGSGSGTEF

TLTISSLEPEDFAVYYCQQYNYWPLTFGGGTKVEIKR
SEQ ID NO: 600

14070_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF

TLTISSLQSEDFAVYYCQQYNYWPLTFGGGTKVEIKR
SEQ ID NO: 601

14071_LC [hu anti-<huCDH19> 16A4.1 (1-235)(G141Q) VL]
EIVLTQSPGTLSLSPGERATLSCRASQSVSSSYLAWYQQKPGQAPRLLIYGTSSRATGIPDRFSGSGSGTD

FTLTISRLEPEDFAVYYCQQYGSSPFTFGQGTKVEIKR
SEQ ID NO: 602

TABLE II-continued

14072_LC [hu anti-<huCDH19> 19B5.1 (1-235)(K45Q,S102A) VL]
QSALTQPPSTTGTPGQRVTISCSGSRSNIGSNFVNWYQQLPGTAPKVLIYTNNQRPSGVPDRFSGSKSGTS

ASLAISGLQSEDEADYYCATWDDSMNGWVFGGGTKLTVLG
SEQ ID NO: 603

14073_LC [hu anti-<huCDH19> 19B5.1 (1-235)(K45Q,S102A) VL]
QSALTQPPSTTGTPGQRVTISCSGSRSNIGSNFVNWYQQLPGTAPKVLIYTNNQRPSGVPDRFSGSKSGTS

ASLAISGLQSEDEADYYCATWDDSMNGWVFGGGTKLTVLG
SEQ ID NO: 604

14074_LC [hu anti-<huCDH19> 19B5.1 (1-235)(T11V,K45Q,S102A) VL]
QSALTQPPSVTGTPGQRVTISCSGSRSNIGSNFVNWYQQLPGTAPKVLIYTNNQRPSGVPDRFSGSKSGT

SASLAISGLQSEDEADYYCATWDDSMNGWVFGGGTKLTVLG
SEQ ID NO: 605

14075_LC [hu anti-<huCDH19> 19B5.1
(1-235)(T11V,K45Q,S102A,D111E,N135Q) VL]
QSALTQPPSVTGTPGQRVTISCSGSRSNIGSNFVNWYQQLPGTAPKVLIYTNNQRPSGVPDRFSGSKSGT

SASLAISGLQSEDEADYYCATWDESMQGWVFGGGTKLTVLG
SEQ ID NO: 606

14076_LC [hu anti-<huCDH19> 19B5.1
(1-235)(T11V,K45Q,S102A,W109Y,D111E,N135Q) VL]
QSALTQPPSVTGTPGQRVTISCSGSRSNIGSNFVNWYQQLPGTAPKVLIYTNNQRPSGVPDRFSGSKSGT

SASLAISGLQSEDEADYYCATYDESMQGWVFGGGTKLTVLG
SEQ ID NO: 607

14077_LC [hu anti-<huCDH19> 23A10.3 (1-231)(C42S) VL]
SYELTQPPSVSVSPGQTASITCSGDRLGEKYVSWYQQKPGQSPILVIYQDNKWPSGIPERFSGSNSGNTA

TLTISGTQAMDEADYYCQAWDSSTVVFGGGTKLTVLG
SEQ ID NO: 608

14078_LC [hu anti-<huCDH19> 23A10.3 (1-231)(C42S) VL]
SYELTQPPSVSVSPGQTASITCSGDRLGEKYVSWYQQKPGQSPILVIYQDNKWPSGIPERFSGSNSGNTA

TLTISGTQAMDEADYYCQAWDSSTVVFGGGTKLTVLG
SEQ ID NO: 609

14079_LC [hu anti-<huCDH19> 23A10.3 (1-231)(C42S,D110E) VL]
SYELTQPPSVSVSPGQTASITCSGDRLGEKYVSWYQQKPGQSPILVIYQDNKWPSGIPERFSGSNSGNTA

TLTISGTQAMDEADYYCQAWESSTVVFGGGTKLTVLG
SEQ ID NO: 610

14080_LC [hu anti-<huCDH19> 23A10.3 (1-231)(C42Y) VL]
SYELTQPPSVSVSPGQTASITCSGDRLGEKYVYWYQQKPGQSPILVIYQDNKWPSGIPERFSGSNSGNTA

TLTISGTQAMDEADYYCQAWDSSTVVFGGGTKLTVLG
SEQ ID NO: 611

14081_LC [hu anti-<huCDH19> 25G10.1 (1-235)(H105Y) VL]
EIVLTQSPGTLSLSPGERATLSCRASQSVSSSYLAWYQQKPGQAPRLLIFGASSRATGIPDRFSGSGSGTD

FTLTISRLEPEDFAVYYCQQYGNSPLTFGGGTKVEIKR
SEQ ID NO: 612

14082_LC [hu anti-<huCDH19> 25G10.1 (1-235)(H105Y) VL]
EIVLTQSPGTLSLSPGERATLSCRASQSVSSSYLAWYQQKPGQAPRLLIFGASSRATGIPDRFSGSGSGTD

FTLTISRLEPEDFAVYYCQQYGNSPLTFGGGTKVEIKR
SEQ ID NO: 613

14083_LC [hu anti-<huCDH19> 26D1.1 (1-235)(S7P) VL]
HSVLTQPPSASGTPGQRVTISCSGSRSNIGSNFVNWYQQLPGTAPKLLIYTNNQRPSGVPDRFSGSKSGTS

ASLAISGLQSEDEADYYCAVWDDSLNGWVFGGGTKLTVLG
SEQ ID NO: 614

14084_LC [hu anti-<huCDH19> 26D1.1 (1-235)(H1Q,S7P) VL]
QSVLTQPPSASGTPGQRVTISCSGSRSNIGSNFVNWYQQLPGTAPKLLIYTNNQRPSGVPDRFSGSKSGTS

ASLAISGLQSEDEADYYCAVWDDSLNGWVFGGGTKLTVLG
SEQ ID NO: 615

TABLE II-continued

14085_LC [hu anti-<huCDH19> 26D1.1 (1-235)(H1Q,S7P,W109Y) VL]
QSVLTQPPSASGTPGQRVTISCSGSRSNIGSNFVNWYQQLPGTAPKLLIYTNNQRPSGVPDRFSGSKSGTS

ASLAISGLQSEDEADYYCAVYDDSLNGWVFGGGTKLTVLG
SEQ ID NO: 616

14086_LC [hu anti-<huCDH19> 26D1.1
(1-235)(H1Q,S7P,W109Y,D111E,N135Q) VL]
QSVLTQPPSASGTPGQRVTISCSGSRSNIGSNFVNWYQQLPGTAPKLLIYTNNQRPSGVPDRFSGSKSGTS

ASLAISGLQSEDEADYYCAVYDESLQGWVFGGGTKLTVLG
SEQ ID NO: 617

14087_LC [hu anti-<huCDH19> 26D1.1
(1-235)(H1Q,S7P,W109Y,D111E,N135Q) VL]
QSVLTQPPSASGTPGQRVTISCSGSRSNIGSNFVNWYQQLPGTAPKLLIYTNNQRPSGVPDRFSGSKSGTS

ASLAISGLQSEDEADYYCAVYDESLQGWVFGGGTKLTVLG
SEQ ID NO: 618

14088_LC [hu anti-<huCDH19> 26D1.1 (1-235)(H1Q,S7P) VL]
QSVLTQPPSASGTPGQRVTISCSGSRSNIGSNFVNWYQQLPGTAPKLLIYTNNQRPSGVPDRFSGSKSGTS

ASLAISGLQSEDEADYYCAVWDDSLNGWVFGGGTKLTVLG
SEQ ID NO: 619

14089_LC [hu anti-<huCDH19> 26F12.1 (1-235)(S7P) VL]
QSVLTQPPSASGTPGQKVTISCSGSRSNIGSNFVNWYQQLPGTAPKLLIYTNYQRPSGVPDRFSGSKSGTS

ASLAISGLQSEDEADYYCAVWDDSLNGWVFGGGTKLTVLG
SEQ ID NO: 620

14090_LC [hu anti-<huCDH19> 26F12.1 (1-235)(S7P,D111E) VL]
QSVLTQPPSASGTPGQKVTISCSGSRSNIGSNFVNWYQQLPGTAPKLLIYTNYQRPSGVPDRFSGSKSGTS

ASLAISGLQSEDEADYYCAVWDESLNGWVFGGGTKLTVLG
SEQ ID NO: 621

14091_LC [hu anti-<huCDH19> 26F12.1 (1-235)(S7P,D111E) VL]
QSVLTQPPSASGTPGQKVTISCSGSRSNIGSNFVNWYQQLPGTAPKLLIYTNYQRPSGVPDRFSGSKSGTS

ASLAISGLQSEDEADYYCAVWDESLNGWVFGGGTKLTVLG
SEQ ID NO: 622

14092_LC [hu anti-<huCDH19> 26F12.1 (1-235)(S7P,W109Y,D111E,N135Q) VL]
QSVLTQPPSASGTPGQKVTISCSGSRSNIGSNFVNWYQQLPGTAPKLLIYTNYQRPSGVPDRFSGSKSGTS

ASLAISGLQSEDEADYYCAVYDESLQGWVFGGGTKLTVLG
SEQ ID NO: 623

14093_LC [hu anti-<huCDH19> 25F8.1 (1-235)(K45Q) VL]
QSALTQPPSATGTPGQRVTISCSGSSSNIGRNFVNWYQQLPGTAPKVLIYTNNQRPSGVPDRFSGSKSGT

SASLAISGLQSEDESDYYCAAWDDSLNGWVFGGGTKLTVLG
SEQ ID NO: 624

14094_LC [hu anti-<huCDH19> 25F8.1 (1-235)(K45Q,S102A) VL]
QSALTQPPSATGTPGQRVTISCSGSSSNIGRNFVNWYQQLPGTAPKVLIYTNNQRPSGVPDRFSGSKSGT

SASLAISGLQSEDEADYYCAAWDDSLNGWVFGGGTKLTVLG
SEQ ID NO: 625

14095_LC [hu anti-<huCDH19> 25F8.1 (1-235)(K45Q,S102A) VL]
QSALTQPPSATGTPGQRVTISCSGSSSNIGRNFVNWYQQLPGTAPKVLIYTNNQRPSGVPDRFSGSKSGT

SASLAISGLQSEDEADYYCAAWDDSLNGWVFGGGTKLTVLG
SEQ ID NO: 626

14096_LC [hu anti-<huCDH19> 25F8.1 (1-235)(K45Q,S102A,D111E) VL]
QSALTQPPSATGTPGQRVTISCSGSSSNIGRNFVNWYQQLPGTAPKVLIYTNNQRPSGVPDRFSGSKSGT

SASLAISGLQSEDEADYYCAAWDESLNGWVFGGGTKLTVLG
SEQ ID NO: 627

14097_LC [hu anti-<huCDH19> 25F8.1 (1-235)(K45Q,S102A,D111E,N135Q) VL]
QSALTQPPSATGTPGQRVTISCSGSSSNIGRNFVNWYQQLPGTAPKVLIYTNNQRPSGVPDRFSGSKSGT

SASLAISGLQSEDEADYYCAAWDESLQGWVFGGGTKLTVLG
SEQ ID NO: 628

TABLE II-continued

14098_LC [hu anti-<huCDH19> 22D1.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATWDDSMNGWVFGGGTKLTVLG
SEQ ID NO: 629

14099_LC [hu anti-<huCDH19> 22D1.1 (1-235)(K45Q,S102A,D111E,N135Q) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATWDESMQGWVFGGGTKLTVLG
SEQ ID NO: 630

14100_LC [hu anti-<huCDH19> 22D1.1 (1-235)(K45Q,S102A,W109Y,D111E,N135Q) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATYDESMQGWVFGGGTKLTVLG
SEQ ID NO: 631

14101_LC [hu anti-<huCDH19> 22D1.1 (1-235)(K45Q,S102A,W109Y) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATYDDSMNGWVFGGGTKLTVLG
SEQ ID NO: 632

14102_LC [hu anti-<huCDH19> 22D1.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS

ASLAISGLQSEDEADYYCATWDDSMNGWVFGGGTKLTVLG
SEQ ID NO: 633

13591_LC [hu anti-<huCDH19> 4F7 VL]
QSVLTQPPSVSGAPGQRVTISCTGSSSNIGTGYDVHWYQQLPGTAPKLLIHGNSNRPSGVPDRFSGSKSG

TSASLAITGLQAEDEADYYCQSYDSSLSGWVFGGGTRLTVLG
SEQ ID NO: 634

14301_LC [hu anti-<huCDH19> 2G6 (1-234)(D110E) VL]
SYELTQPPSVSVSPGQTASITCSGDRLGEKYTCWYQQRPGQSPLLVIYQDTKRPSGIPERFSGSNSGNTAT

LTISGTQAMDEADYYCQAWESSTVVFGGGTKLTVLG
SEQ ID NO: 635

14302_LC [hu anti-<huCDH19> 2G6 (1-234)(C42S,D110E) VL]
SYELTQPPSVSVSPGQTASITCSGDRLGEKYTSWYQQRPGQSPLLVIYQDTKRPSGIPERFSGSNSGNTAT

LTISGTQAMDEADYYCQAWESSTVVFGGGTKLTVLG
SEQ ID NO: 636

14303_LC [hu anti-<huCDH19> 2G6 (1-234)(C42S,D110E) VL]
SYELTQPPSVSVSPGQTASITCSGDRLGEKYTSWYQQRPGQSPLLVIYQDTKRPSGIPERFSGSNSGNTAT

LTISGTQAMDEADYYCQAWESSTVVFGGGTKLTVLG
SEQ ID NO: 637

14304_LC [hu anti-<huCDH19> 23A10.3 (1-231)(C42S) VL]
SYELTQPPSVSVSPGQTASITCSGDRLGEKYVSWYQQKPGQSPILVIYQDNKWPSGIPERFSGSNSGNTA

TLTISGTQAMDEADYYCQAWDSSTVVFGGGTKLTVLG
SEQ ID NO: 638

Anti-CDH19 Variable and Constant Region Polynucleotide and Amino Acid Sequences

TABLE III a: Heavy Chain Variable and Contant Region Polynucleotide and Amino acid Sequences 2G6
CAGGTGCAGTTGGTGGAGTCTGGGGGAGGCGTGGTCCAGCCTGGGAGGTCCCTGAGACTCTCCTGT
GCAGCGTCTGGATTCACCTTCAGTAGCTATGGCATGCACTGGGTCCGCCAGGCTCCAGGCAAGGGG
CTGGAGTGGGTGGCATTTATATGGTATGATGGAAGTAATAAATACTATGCAGACTCCGTGAAGGAC
CGATTCACCATCTCCAGAGACAATTCCAAGAACACGCTGTATCTGCAAATGAAAAGCCTGAGAGCT
GAGGACACGGCTGTGTATTACTGTGCGAGAAGGGCCGGTATAATAGGAACTATAGGCTACTACTAC
GGTATGGACGTCTGGGGCCAAGGGACCACGGTCACCGTCTCTAGTGCCTCCACCAAGGGCCCATCG
GTCTTCCCCCTGGCACCCTCCTCCAAGAGCACCTCTGGGGGCACAGCGGCCCTGGGCTGCCTGGTC TABLE III-continued

```
AAGGACTACTTCCCCGAACCGGTGACGGTGTCGTGGAACTCAGGCGCCCTGACCAGCGGCGTGCAC
ACCTTCCCGGCTGTCCTACAGTCCTCAGGACTCTACTCCCTCAGCAGCGTGGTGACCGTGCCCTCCA
GCAGCTTGGGCACCCAGACCTACATCTGCAACGTGAATCACAAGCCCAGCAACACCAAGGTGGAC
AAGAAAGTTGAGCCCAAATCTTGTGACAAAACTCACACATGCCCACCGTGCCCAGCACCTGAACTC
CTGGGGGGACCGTCAGTCTTCCTCTTCCCCCCAAAACCCAAGGACACCCTCATGATCTCCCGGACC
CCTGAGGTCACATGCGTGGTGGTGGACGTGAGCCACGAAGACCCTGAGGTCAAGTTCAACTGGTAC
GTGGACGGCGTGGAGGTGCATAATGCCAAGACAAAGCCGCGGGAGGAGCAGTACAACAGCACGT
ACCGTGTGGTCAGCGTCCTCACCGTCCTGCACCAGGACTGGCTGAATGGCAAGGAGTACAAGTGCA
AGGTCTCCAACAAAGCCCTCCCAGCCCCCATCGAGAAAACCATCTCCAAAGCCAAAGGGCAGCCC
CGAGAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTATAGCA
AGCTCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAATGA
SEQ ID NO: 639

QVQLVESGGGVVQPGRSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 640

4A2
CAGGTGCAGCTGCAGGAGTCGGGCCCAGGACTGGTGAAGCCTTCACAGACCCTGTCCCTCACCTGC
ACTGTCTCTGGTGGCTCCATCAGCAGTAGTGGTTACTACTGGAGCTGGATCCGCCAGCACCCAGGG
AAGGGCCTGGAGTGGATTGGGTACATCTATTACACTGGGAGCGCCTACTACAACCCGTCCCTCAAG
AGTCGAGTTACCATATCAGTAGACACGTCTAAGAACCAGTTCTCCCTGAAGCTGAGCTCTGTGACT
GCCGCGGACACGGCCGTGTATTACTGTGCGAGAGATGGAAGCAGTGGCTGGTACTTCCAGTATTGG
GGCCAGGGCACCCTGGTCACCGTCTCTAGTGCCTCCACCAAGGGCCCATCGGTCTTCCCCCTGGCA
CCCTCCTCCAAGAGCACCTCTGGGGGCACAGCGGCCCTGGGCTGCCTGGTCAAGGACTACTTCCCC
GAACCGGTGACGGTGTCGTGGAACTCAGGCGCCCTGACCAGCGGCGTGCACACCTTCCCGGCTGTC
CTACAGTCCTCAGGACTCTACTCCCTCAGCAGCGTGGTGACCGTGCCTCCAGCAGCTTGGGCACC
CAGACCTACATCTGCAACGTGAATCACAAGCCCAGCAACACCAAGGTGGACAAGAAAGTTGAGCC
CAAATCTTGTGACAAAACTCACACATGCCCACCGTGCCCAGCACCTGAACTCCTGGGGGGACCGTC
AGTCTTCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGTGTGGTCAGCG
TCCTCACCGTCCTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGAGAACCACAGGT
GTACACCCTGCCCCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGAGAACAACTACA
AGACCACGCCTCCCGTGCTGGACTCCGACGGCTCCTTCTTCCTCTATAGCAAGCTCACCGTGGACA
AGAGCAGGTGGCAGCAGGGGAACGTCTTCTCATGCTCCGTGATGCATGAGGCTCTGCACAACCACT
ACACGCAGAAGAGCCTCTCCCTGTCTCCGGGTAAATGA
SEQ ID NO: 641

QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 642

4A9
CAGGTGCAGCTGCAGGAGTCGGGCCCAGGACTGGTGAAGCCTTCGGAGACCCTGTCCCTCACCTGC
ACTGTCTCTGGTGGCTCCATCAGTGGTTACTACTGGAGCTGGATCCGCCAGCCCCCAGGAAAGGGA
CTGGAGTGGTTTGCATATTTCTCTTACAGTGGGAGCACCAACTACAACCCCTCCCTCAAGAGTCGA
GTCACCTTATCAGTAGACACGTCCAAGAACCAGTTCTCCCTGAAGCTGAGCTCTGTGACCGCTGCG
GACACGGCCGTGTATTACTGTGCGAGGAACTGGGCCTTCCACTTTGACTTCTGGGGCCAGGGAACC
CTGGTCACCGTCTCTAGTGCCTCCACCAAGGGCCCATCGGTCTTCCCCCTGGCACCCTCCTCCAAGA
GCACCTCTGGGGGCACAGCGGCCCTGGGCTGCCTGGTCAAGGACTACTTCCCCGAACCGGTGACGG
TGTCGTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAAAGTTGAGCCCAAATCTTGTGAC
AAAACTCACACATGCCCACCGTGCCCAGCACCTGAACTCCTGGGGGGACCGTCAGTCTTCCTCTTC
CCCCCAAAACCCAAGGACACCCTCATGATCTCCCGGACCCCTGAGGTCACATGCGTGGTGGTGGAC
GTGAGCCACGAAGACCCTGAGGTCAAGTTCAACTGGTACGTGGACGGCGTGGAGGTGCATAATGC
CAAGACAAAGCCGCGGGAGGAGCAGTACAACAGCACGTACCGTGTGGTCAGCGTCCTCACCGTCC
TGCACCAGGACTGGCTGAATGGCAAGGAGTACAAGTGCAAGGTCTCCAACAAAGCCCTCCCAGCC
CCCATCGAGAAAACCATCTCCAAAGCCAAAGGGCAGCCCCGAGAACCACAGGTGTACACCCTGCC
CCCATCCCGGGAGGAGATGACCAAGAACCAGGTCAGCCTGACCTGCCTGGTCAAAGGCTTCTATCC
CAGCGACATCGCCGTGGAGTGGGAGAGCAATGGGCAGCCGGAGAACAACTACAAGACCACGCCTC
```

TABLE III-continued

CCGTGCTGGACTCCGACGGCTCCTTCTTCCTCTATAGCAAGCTCACCGTGGACAAGAGCAGGTGGC
AGCAGGGGAACGTCTTCTCATGCTCCGTGATGCATGAGGCTCTGCACAACCACTACACGCAGAAGA
GCCTCTCCCTGTCTCCGGGTAAATGA
SEQ ID NO: 643

QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 644

4B10
CAGGTGCAGCTGGTGGAGTCTGGGGGAGGCGTGGTCCAGCCTGGGAGGTCCCTGAGACTCTCCTGT
GCAGCCTCTGGATTCACCTTCAGTAGCTATGACATGCACTGGGTCCGCCAGGCTCCAGGCAAGGGG
CTGGAGTGGGTGGCAGTTATATCATATGATGGAACTAATGAATACTATGCAGACTCCGTGAAGGGC
CGATTCACCATCTCCAGAGACACTTCCAAGAACACGCTGTATTTGCAAATGAACAGCCTGAGAGCT
GAGGACACGGCTGTATATTACTGTGCGAGAGAACGATATTTTGACTGGTCTTTTGACTACTGGGGC
CAGGGAACCCTGGTCAGCGTCTCTAGTGCCTCCACCAAGGGCCCATCGGTCTTCCCCCTGGCACCC
TCCTCCAAGAGCACCTCTGGGGGCACAGCGGCCCTGGGCTGCCTGGTCAAGGACTACTTCCCCGAA
CCGGTGACGGTGTCGTGGAACTCAGGCGCCCTGACCAGCGGCGTGCACACCTTCCCGGCTGTCCTA
CAGTCCTCAGGACTCTACTCCCTCAGCAGCGTGGTGACCGTGCCCTCCAGCAGCTTGGGCACCCAG
ACCTACATCTGCAACGTGAATCACAAGCCCAGCAACACCAAGGTGGACAAGAAAGTTGAGCCCAA
ATCTTGTGACAAAACTCACACATGCCCACCGTGCCCAGCACCTGAACTCCTGGGGGGACCGTCAGT
CTTCCTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGAGGT
GCATAATGCCAAGACAAAGCCGCGGGAGGAGCAGTACAACAGCACGTACCGTGTGGTCAGCGTCC
TCACCGTCCTGCACCAGGACTGGCTGAATGGCAAGGAGTACAAGTGCAAGGTCTCCAACAAAGCC
CTCCCAGCCCCCATCGAGAAAACCATCTCCAAAGCCAAAGGGCAGCCCCGAGAACCACAGGTGTA
CACCCTGCCCCCATCCCGGGAGGAGATGACCAAGAACCAGGTCAGCCTGACCTGCCTGGTCAAAG
GCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTATAGCAAGCTCACCGTGGACAAG
AGCAGGTGGCAGCAGGGGAACGTCTTCTCATGCTCCGTGATGCATGAGGCTCTGCACAACCACTAC
ACGCAGAAGAGCCTCTCCCTGTCTCCGGGTAAATGA
SEQ ID NO: 645

QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 646

4F3
CAGGTGCAGCTGGTGGAGTCTGGGGGAGGCGTGGTCCAGCCTGGGAGGTCCCTGAGACTCTCCTGT
GCAGCGTCTGGATTCTCCTTCAGTAGCTATGACATGGACTGGGTCCGCCAGACTCCAGGCAAGGGG
CTGGAGTGGGTGGCAGTTATATGGTATGATGGAAGTAATAAATACTATGCAGACTCCGTGAGGGGC
CGATTCACCATCTCCAGAGACAATTCCAAGAACACGCTGTTTCTGCAAATGAACAGCCTGAGAGTC
GAGGACACGGCTGTGTATTACTGTGCGAGAGAAACTGGGGAGGGCTGGTACTTCGATCTCTGGGGC
CGTGGCACCCTGGTCACCGTCTCTAGTGCCTCCACCAAGGGCCCATCGGTCTTCCCCCTGGCACCCT
CCTCCAAGAGCACCTCTGGGGGCACAGCGGCCCTGGGCTGCCTGGTCAAGGACTACTTCCCCGAAC
CGGTGACGGTGTCGTGGAACTCAGGCGCCCTGACCAGCGGCGTGCACACCTTCCCGGCTGTCCTAC
AGTCCTCAGGACTCTACTCCCTCAGCAGCGTGGTGACCGTGCCCTCCAGCAGCTTGGGCACCCAGA
CCTACATCTGCAACGTGAATCACAAGCCCAGCAACACCAAGGTGGACAAGAAAGTTGAGCCCAAA
TCTTGTGACAAAACTCACACATGCCCACCGTGCCCAGCACCTGAACTCCTGGGGGGACCGTCAGTC
TTCCTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGAGGT
GCATAATGCCAAGACAAAGCCGCGGGAGGAGCAGTACAACAGCACGTACCGTGTGGTCAGCGTCC
TCACCGTCCTGCACCAGGACTGGCTGAATGGCAAGGAGTACAAGTGCAAGGTCTCCAACAAAGCC
CTCCCAGCCCCCATCGAGAAAACCATCTCCAAAGCCAAAGGGCAGCCCCGAGAACCACAGGTGTA
CACCCTGCCCCCATCCCGGGAGGAGATGACCAAGAACCAGGTCAGCCTGACCTGCCTGGTCAAAG
GCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTATAGCAAGCTCACCGTGGACAAG
AGCAGGTGGCAGCAGGGGAACGTCTTCTCATGCTCCGTGATGCATGAGGCTCTGCACAACCACTAC
ACGCAGAAGAGCCTCTCCCTGTCTCCGGGTAAATGA
SEQ ID NO: 647

QVQLVESGGGVVQPGRSLRLSCAASGFSFSSYDMDWVRQTPGKGLEWVAVIWYDGSNKYYADSVRG
RFTISRDNSKNTLFLQMNSLRVEDTAVYYCARETGEGWYFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV

TABLE III-continued

KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 648

4F7
CAGGTGCAGCTGCAGGAGTCGGGCCCAGGACTGGTGAAGCCTTCGGAGACCCTGTCCCTCACCTGC
ACTGTCTCTGGTGGCTCCATCAGTAGTTACTCCTGGAGCTGGATCCGGCAGCCCCCAGGGAAGGGA
CTGGAGTGGATTGGGTATATCTATTACAGTGGGAGCACCAACTACAACCCCTCCCTCAAGAGTCGA
GTCACCATATCATTAGACACGTCCAAGAACCAGTTCTCCCTGAAGCTGAGCTCTGTGACCGCTGCG
GACACGGCCGTGTATTACTGTGCGAGGAACTGGGCCTTCCACTTTGACTACTGGGGCCAGGGAACC
CTGGTCACCGTCTCTAGTGCCTCCACCAAGGGCCCATCGGTCTTCCCCCTGGCACCCTCCTCCAAGA
GCACCTCTGGGGGCACAGCGGCCCTGGGCTGCCTGGTCAAGGACTACTTCCCCGAACCGGTGACGG
TGTCGTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAAAGTTGAGCCCAAATCTTGTGAC
AAAACTCACACATGCCCACCGTGCCCAGCACCTGAACTCCTGGGGGGACCGTCAGTCTTCCTCTTC
CCCCCAAAACCCAAGGACACCCTCATGATCTCCCGGACCCCTGAGGTCACATGCGTGGTGGTGGAC
GTGAGCCACGAAGACCCTGAGGTCAAGTTCAACTGGTACGTGGACGGCGTGGAGGTGCATAATGC
CAAGACAAAGCCGCGGGAGGAGCAGTACAACAGCACGTACCGTGTGGTCAGCGTCCTCACCGTCC
TGCACCAGGACTGGCTGAATGGCAAGGAGTACAAGTGCAAGGTCTCCAACAAAGCCCTCCCAGCC
CCCATCGAGAAAACCATCTCCAAAGCCAAAGGGCAGCCCCGAGAACCACAGGTGTACACCCTGCC
CCCATCCCGGGAGGAGATGACCAAGAACCAGGTCAGCCTGACCTGCCTGGTCAAAGGCTTCTATCC
CAGCGACATCGCCGTGGAGTGGGAGAGCAATGGGCAGCCGGAGAACAACTACAAGACCACGCCTC
CCGTGCTGGACTCCGACGGCTCCTTCTTCCTCTATAGCAAGCTCACCGTGGACAAGAGCAGGTGGC
AGCAGGGGAACGTCTTCTCATGCTCCGTGATGCATGAGGCTCTGCACAACCACTACACGCAGAAGA
GCCTCTCCCTGTCTCCGGGTAAATGA
SEQ ID NO: 649

QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 650

16A4
CAGGTGCAGCTGCAGGAGTCGGGCCCAGGACTGGCGAAGCCTTCGGAGACCCTGTCCCTCACCTGC
ACTGTCTCTGGTGACTCCATCACTAGTTACTACTGGAGCTGGATCCGGCAGCCCCCAGGGAAGGGA
CTGGAGTGGATTGGGTATATCTATTACAGCGGGAGCACCAATTACAACCCCTCCCTCAAGAGTCGA
GTCACCATATCAGTAGACACGTCCAAGAACCAGTTCTCCCTGAAGCTGAGTTCTGTGACCGCTGCG
GACACGGCCGTGTATTACTGTGCGAGAGATCAAAGGCGGATAGCAGCAGCTGGTACCCACTTCTAC
GGTATGGACGTCTGGGGCCAAGGGACCACGGTCACTGTCTCCTCAGCTTCCACCAAGGGCCCATCC
GTCTTCCCCCTGGCGCCCTCCTCCAAGAGCACCTCTGGGGGCACAGCGGCCCTGGGCTGCCTGGTC
AAGGACTACTTCCCCGAACCGGTGACGGTGTCGTGGAACTCAGGCGCCCTGACCAGCGGCGTGCA
CACCTTCCCGGCTGTCCTACAGTCCTCAGGACTCTACTCCCTCAGCAGCGTGGTGACCGTGCCCTCC
AGCAGCTTGGGCACCCAGACCTACATCTGCAACGTGAATCACAAGCCCAGCAACACCAAGGTGGA
CAAGAAAGTTGAGCCCAAATCTTGTGACAAAACTCACACATGCCCACCGTGCCCAGCACCTGAACT
CCTGGGGGGACCGTCAGTCTTCCTCTTCCCCCCAAAACCCAAGGACACCCTCATGATCTCCCGGAC
CCCTGAGGTCACATGCGTGGTGGTGGACGTGAGCCACGAAGACCCTGAGGTCAAGTTCAACTGGTA
CGTGGACGGCGTGGAGGTGCATAATGCCAAGACAAAGCCGCGGGAGGAGCAGTACAACAGCACGT
ACCGTGTGGTCAGCGTCCTCACCGTCCTGCACCAGGACTGGCTGAATGGCAAGGAGTACAAGTGCA
AGGTCTCCAACAAAGCCCTCCCAGCCCCCATCGAGAAAACCATCTCCAAAGCCAAAGGGCAGCCCC
GAGAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTATAGCA
AGCTCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAATGA
SEQ ID NO: 651

QVQLQESGPGLAKPSETLSLTCTVSGDSITSYYWSWIRQPPGKGLEWIGYIYYSGSTNYNPSLKSRVTISV
DTSKNQFSLKLSSVTAADTAVYYCARDQRRIAAAGTHFYGMDVWGQGTTVTVSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 652

16C1
CAGGTGCAGCTGCAGGAGTCGGGCCCAGGACTGGTGAAGCCTTCGGAGACCCTGTCCCTCACTTGT
ACTGTCTCTGGTGGCTCCATCAGTGGTTACTACTGGAGCTGGATCCGGCAGCCCCCAGGGAAGGGA
CTGGAGTGGATTGGGTATATCTATTACATTGGGAGCACCAACTACAACCCCTCCCTCAAGAGTCGA
GTCACCATGTCAATAGACACGTCCAAGAACCAGTTCTCCCTGACGCTGAGCTTTGACCGCTGCG
GACACGGCCGTGTATTTCTGTGCGAGAGATGGGAGCAGTGGCTGGTACCGGTGGTTCGACCCCTGG
GGCCAGGGAACCCTGGTCACCGTCTCCTCAGCTTCCACCAAGGGCCCATCCGTCTTCCCCCTGGCG
CCCTCCTCCAAGAGCACCTCTGGGGGCACAGCGGCCCTGGGCTGCCTGGTCAAGGACTACTTCCCC
GAACCGGTGACGGTGTCGTGGAACTCAGGGGCCCTGACCAGCGGCGTGCACACCTTCCCGGCTGTC

TABLE III-continued

```
CTACAGTCCTCAGGACTCTACTCCCTCAGCAGCGTGGTGACCGTGCCCTCCAGCAGCTTGGGCACC
CAGACCTACATCTGCAACGTGAATCACAAGCCCAGCAACACCAAGGTGGACAAGAAAGTTGAGCC
CAAATCTTGTGACAAAACTCACACATGCCCACCGTGCCCAGCACCTGAACTCCTGGGGGGACCGTC
AGTCTTCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGTGTGGTCAGCG
TCCTCACCGTCCTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGAGAACCACAGGT
GTACACCCTGCCCCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGAGAACAACTACA
AGACCACGCCTCCCGTGCTGGACTCCGACGGCTCCTTCTTCCTCTATAGCAAGCTCACCGTGGACA
AGAGCAGGTGGCAGCAGGGGAACGTCTTCTCATGCTCCGTGATGCATGAGGCTCTGCACAACCACT
ACACGCAGAAGAGCCTCTCCCTGTCTCCGGGTAAATGA
SEQ ID NO: 653

QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 654

17H8
CAGGTGCAGCTGCAGGAGTCGGGCCCAGGACTGGTGAAGCCTTCGGAGACCCTGTCCCTCACGTGC
ACTGTCTCTGGTGGCTCCATCAATAGTTACTACTGGAGCTGGATCCGGCAGCCCCCAGGGAAGGGA
CTGGAGTGGATTGGGTATATCTATTACATTGGGAGCACCAACTACAACCCCTCCCTCAAGAGTCGC
GTCACCATATCAGTAGACACGTCCAAGAACCAGTTCTCCCTGAAGCTGAGCTCTGTGACCGCTGCG
GACACGGCCCTGTATTACTGTGCGAGAGATTCCCGGTATAGAAGTGGCTGGTACGATGCTTTTGAT
ATCTGGGGCCAAGGGACAATGGTCACCGTCTCTTCAGCTTCCACCAAGGGCCCATCCGTCTTCCCC
CTGGCGCCCTCCTCCAAGAGCACCTCTGGGGGCACAGCGGCCCTGGGCTGCCTGGTCAAGGACTAC
TTCCCCGAACCGGTGACGGTGTCGTGGAACTCAGGGGCCCTGACCAGCGGCGTGCACACCTTCCCG
GCTGTCCTACAGTCCTCAGGACTCTACTCCCTCAGCAGCGTGGTGACCGTGCCCTCCAGCAGCTTGG
GCACCCAGACCTACATCTGCAACGTGAATCACAAGCCCAGCAACACCAAGGTGGACAAGAAAGTT
GAGCCCAAATCTTGTGACAAAACTCACACATGCCCACCGTGCCCAGCACCTGAACTCCTGGGGGGA
CCGTCAGTCTTCCTCTTCCCCCCAAAACCCAAGGACACCCTCATGATCTCCCGGACCCCTGAGGTCA
CATGCGTGGTGGTGGACGTGAGCCACGAAGACCCTGAGGTCAAGTTCAACTGGTACGTGGACGGC
GTGGAGGTGCATAATGCCAAGACAAAGCCGCGGGAGGAGCAGTACAACAGCACGTACCGTGTGGT
CAGCGTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAACCAC
AGGTGTACACCCTGCCCCCATCCCGGGAGGAGATGACCAAGAACCAGGTCAGCCTGACCTGCCTG
GTCAAAGGCTTCTATCCCAGCGACATCGCCGTGGAGTGGGAGAGCAATGGGCAGCCGGAGAACAA
CTACAAGACCACGCCTCCCGTGCTGGACTCCGACGGCTCCTTCTTCCTCTATAGCAAGCTCACCGTG
GACAAGAGCAGGTGGCAGCAGGGGAACGTCTTCTCATGCTCCGTGATGCATGAGGCTCTGCACAA
CCACTACACGCAGAAGAGCCTCTCCCTGTCTCCGGGTAAATGA
SEQ ID NO: 655

QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 656

19B5
CAGGTGCAGTTGGTGCAGTCTGGGGCTGAGGTGAAGAAGCCTGGGGCCTCAGTGAAGGTTTCCTGC
AAGGTTTCTGGATACACCTTCACCAGCTACTTTATTCACTGGGTGCGCCAGGCCCCTGGACAAGGG
CTTGAATGGATGGGAATTATCAACCCTATTAGTGTTAGCACAAGCTACGCACAGAAGTTCCAGGGC
AGAGTCACCATGACCAGGGACACGTCCACGAGCACAGTCTTCATGGAGCTGAGCAGCCTGAGATC
TGAGGACACGGCCGTGTATTACTGTGCGCGAGGGGGGATACAGCTATGGTTACATTTGGACTACTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
```

TABLE III-continued

```
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 657

QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 658

20D3
CAGGTGCAGCTGGTGCAGTCTGGGGCTGAGGTGAAGAAGCCTGGGGCCTCAGTGAAGGTTTCCTGC
AAGGTTTCTGGATACACCTTCACCAGCTACTTTATTCACTGGGTGCGCCAGGCCCCTGGACAAGGG
CTTGAGTGGATGGGAATAATCAACCCTATTAGTGTTAGCACAAGCTACGCACAGAAGTTCCAGGGC
AGAGTCACCATGACCAGGGACACGTCCACGAGCACAGTCTTCATGGAGCTGAGCAGCCTGAGATC
TGAGGACACGGCCGTGTATTACTGTGCGCGAGGGGGGATACAGCTATGGTTACATTTTGACTACTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 659

QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 660

22D1
CAGGTGCAGCTGGTGCAGTCTGGGGCTGAGGTGAAGAAGCCTGGGGCCTCAGTGAGGGTTTCCTGC
AAGGTTTCTGGATACACCTTCACCAGCTACTTTATTCACTGGGTACGCCAGGCCCCTGGACAAGGG
CTTGAGTGGATGGGAATAATCAACCCTATTAGTGTTAGCACAAGCTACGCACAGAAGTTCCAGGGC
AGAGTCACCATGACCAGGGACACGTCCACGAGCACAGTCTTCATGGAGCTGAGCAGCCTGAGATC
TGAGGACACGGCCGTGTATTACTGTGCGCGAGGGGGGATACAGCTATGGTTACATTTGGACTACTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 661

QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
```

TABLE III-continued

KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 662

22G10
GAGGTGCAACTGTTGGAGTCTGGGGGAGGCTTGGTACAGCCTGGGGGGTCCCTGAGACTCTCCTGT
GCAGCCTCTGGATTCACCTTTAGCAGTTATGCCATGAACTGGGTCCGCCAGGCTCCAGGGAAGGGG
CTGGAGTGGGTCTCAACTATTAGTGGTGGTGGTGCTAACACATACTACGCAGACTCCGTGAAGGGC
CGGTTCACCATCTCCAGTGACAATTCCAAGAGCACGCTGTATCTGCAAATGAACAGCCTGAGAGCC
GCGGACACGGCCGTATATCACTGTGCGAAAGGGGGAATGGGGGGATACTACTACGGTATGGACGT
CTGGGGCCAAGGGACCACGGTCACCGTCTCCTCAGCTTCCACCAAGGGCCCATCCGTCTTCCCCCT
GGCGCCCTCCTCCAAGAGCACCTCTGGGGGCACAGCGGCCCTGGGCTGCCTGGTCAAGGACTACTT
CCCCGAACCGGTGACGGTGTCGTGGAACTCAGGCGCCCTGACCAGCGGCGTGCACACCTTCCCGGC
TGTCCTACAGTCCTCAGGACTCTACTCCCTCAGCAGCGTGGTGACCGTGCCCTCCAGCAGCTTGGGC
ACCCAGACCTACATCTGCAACGTGAATCACAAGCCCAGCAACACCAAGGTGGACAAGAAAGTTGA
GCCCAAATCTTGTGACAAAACTCACACATGCCCACCGTGCCCAGCACCTGAACTCCTGGGGGGACC
GTCAGTCTTCCTCTTCCCCCCAAAACCCAAGGACACCCTCATGATCTCCCGGACCCCTGAGGTCACA
TGCGTGGTGGTGGACGTGAGCCACGAAGACCCTGAGGTCAAGTTCAACTGGTACGTGGACGGCGT
GGAGGTGCATAATGCCAAGACAAAGCCGCGGGAGGAGCAGTACAACAGCACGTACCGTGTGGTCA
GCGTCCTCACCGTCCTGCACCAGGACTGGCTGAATGGCAAGGAGTACAAGTGCAAGGTCTCCAACA
AAGCCCTCCCAGCCCCCATCGAGAAAACCATCTCCAAAGCCAAAGGGCAGCCCCGAGAACCACAG
GTGTACACCCTGCCCCCATCCCGGGAGGAGATGACCAAGAACCAGGTCAGCCTGACCTGCCTGGTC
AAAGGCTTCTATCCCAGCGACATCGCCGTGGAGTGGGAGAGCAATGGGCAGCCGGAGAACAACTA
CAAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 663

EVQLLESGGGLVQPGGSLRLSCAASGFTFSSYAMNWVRQAPGKGLEWVSTISGGGANTYYADSVKGR
FTISSDNSKSTLYLQMNSLRAADTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 664

23A10
CAGGTGCAGCTGGTGGAGTCTGGGGGAGGCGTGGTCCAGCCTGGGAGGTCCCTGAGACTCTCCTGT
GCAGCGTCTGGATTCACCTTCAGTCGCTATGGCATACACTGGGTCCGCCAGGCTCCAGGCAAGGGG
CTGGAGTGGGTGGCAGTTATATGGTATGATGGAAGTAATAAATACTATGCAGACTCCGTGAAGGGC
CGATTCACCATCTCCAGAGACAATTCCAAGAACACGCTGTATCTGCTAATGAACAGCCTGAGAGCC
GAGGACTCGGCTGTGTATTACTGTGCGAGAAGGGCCGGTATACCTGGAACTACGGGCTACTACTAT
GGTATGGACGTCTGGGGCCAAGGGACCACGGTCACCGTCTCCTCAGCTTCCACCAAGGGCCCATCC
GTCTTCCCCCTGGCGCCCTCCTCCAAGAGCACCTCTGGGGGCACAGCGGCCCTGGGCTGCCTGGTC
AAGGACTACTTCCCCGAACCGGTGACGGTGTCGTGGAACTCAGGCGCCCTGACCAGCGGCGTGCA
CACCTTCCCGGCTGTCCTACAGTCCTCAGGACTCTACTCCCTCAGCAGCGTGGTGACCGTGCCCTCC
AGCAGCTTGGGCACCCAGACCTACATCTGCAACGTGAATCACAAGCCCAGCAACACCAAGGTGGA
CAAGAAAGTTGAGCCCAAATCTTGTGACAAAACTCACACATGCCCACCGTGCCCAGCACCTGAACT
CCTGGGGGGACCGTCAGTCTTCCTCTTCCCCCCAAAACCCAAGGACACCCTCATGATCTCCCGGAC
CCCTGAGGTCACATGCGTGGTGGTGGACGTGAGCCACGAAGACCCTGAGGTCAAGTTCAACTGGTA
CGTGGACGGCGTGGAGGTGCATAATGCCAAGACAAAGCCGCGGGAGGAGCAGTACAACAGCACGT
ACCGTGTGGTCAGCGTCCTCACCGTCCTGCACCAGGACTGGCTGAATGGCAAGGAGTACAAGTGCA
AGGTCTCCAACAAAGCCCTCCCAGCCCCCATCGAGAAAACCATCTCCAAAGCCAAAGGGCAGCCC
CGAGAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTATAGCA
AGCTCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAATGA
SEQ ID NO: 665

QVQLVESGGGVVQPGRSLRLSCAASGFTFSRYGIHWVRQAPGKGLEWVAVIWYDGSNKYYADSVKGR
FTISRDNSKNTLYLLMNSLRAEDSAVYYCARRAGIPGTTGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 666

25F8
CAGGTGCAGCTGGTGCAGTCTGGGGCTGAGGTGAAGAAGCCTGGGGCCTCAGTGAAGGTTTCCTGC
AAGGCATCTGGATACACCTTCACCAGCTACTATATTCACTGGGTGCGCCAGGCCCCTGGACAAGGA
CTTGAGTGGATGGGAATAATCAACCCCAGTGGTGGTAGCACAAGGTACGCACAGAAGTTCCAGGG
CAGAGTCACCATGACCAGGGACACGTCCACGAGCACAGTCTTCATGGAGCTGAGCAGCCTGAGAT
CTGAGGACACGGCCGTGTATTACTGTGCGCGAGGGGGAATACAGCTATGGTTACATTTTGACTACT
GGGGCCAGGGAACCCTGGTCACCGTCTCCTCAGCTTCCACCAAGGGCCCATCCGTCTTCCCCCTGG
CGCCCTCCTCCAAGAGCACCTCTGGGGGCACAGCGGCCCTGGGCTGCCTGGTCAAGGACTACTTCC
CCGAACCGGTGACGGTGTCGTGGAACTCAGGGGCCCTGACCAGCGGCGTGCACACCTTCCCGGCTG

TABLE III-continued

```
TCCTACAGTCCTCAGGACTCTACTCCCTCAGCAGCGTGGTGACCGTGCCCTCCAGCAGCTTGGGCA
CCCAGACCTACATCTGCAACGTGAATCACAAGCCCAGCAACACCAAGGTGGACAAGAAAGTTGAG
CCCAAATCTTGTGACAAAACTCACACATGCCCACCGTGCCCAGCACCTGAACTCCTGGGGGACCG
TCAGTCTTCCTCTTCCCCCCAAAACCCAAGGACACCCTCATGATCTCCCGGACCCCTGAGGTCACAT
GCGTGGTGGTGGACGTGAGCCACGAAGACCCTGAGGTCAAGTTCAACTGGTACGTGGACGGCGTG
GAGGTGCATAATGCCAAGACAAAGCCGCGGGAGGAGCAGTACAACAGCACGTACCGTGTGGTCAG
CGTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 667

QVQLVQSGAEVKKPGASVKVSCKASGYTFTSYYTHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 668

25G10
CAGGTGCAGCTGCAGGAGTCGGGCCCAGGACTGGTGAAGCCTTCGGAGACCCTGTCCCTCACCTGC
ACTGTCTCTGGTGGCTCCATCAGTGGTTACTACTGGAGCTGGATCCGGCAGCCCCCAGGGAAGGGA
CTGGAGTGGATTGGGTATATCTATTACATTGGGAGCACCAACTACAACCCCTCCCTCAAGAGTCGA
GTCACCATGTCAGTAGACACGTCCAAGAACCAGTTCTCCCTGAAGCTGAGCTCTGTGACCGCTGCG
GACACGGCCGTGTATTACTGTGCGAGAGATGGGAGCAGTGGCTGGTACCGGTGGTTCGACCCCTGG
GGCCAGGGAACCCTGGTCACCGTCTCCTCAGCTTCCACCAAGGGCCCATCCGTCTTCCCCCTGGCG
CCCTCCTCCAAGAGCACCTCTGGGGGCACAGCGGCCCTGGGCTGCCTGGTCAAGGACTACTTCCCC
GAACCGGTGACGGTGTCGTGGAACTCAGGGGCCCTGACCAGCGGCGTGCACACCTTCCCGGCTGTC
CTACAGTCCTCAGGACTCTACTCCCTCAGCAGCGTGGTGACCGTGCCCTCCAGCAGCTTGGGCACC
CAGACCTACATCTGCAACGTGAATCACAAGCCCAGCAACACCAAGGTGGACAAGAAAGTTGAGCC
CAAATCTTGTGACAAAACTCACACATGCCCACCGTGCCCAGCACCTGAACTCCTGGGGGACCGTC
AGTCTTCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGTGTGGTCAGCG
TCCTCACCGTCCTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGAGAACCACAGGT
GTACACCCTGCCCCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGAGAACAACTACA
AGACCACGCCTCCCGTGCTGGACTCCGACGGCTCCTTCTTCCTCTATAGCAAGCTCACCGTGGACA
AGAGCAGGTGGCAGCAGGGGAACGTCTTCTCATGCTCCGTGATGCATGAGGCTCTGCACAACCACT
ACACGCAGAAGAGCCTCTCCCTGTCTCCGGGTAAATGA
SEQ ID NO: 669

QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPG
SEQ ID NO: 670

26D1
CAGGTGCAGTTGGTGCAGTCTGGGGCTGAGGTGAAGAAGCCTGGGGCCTCAGTGAAGGTTTCCTGT
AAGGCATCTAGATACACCTTCACCAGCTACTATATGTCCTGGGTGCGACAGGCCCTGGACAAGGG
CTTGAGTGGATGGGAATAATCCACCCTAGTGGTGGTGACACAACCTACGCACAGAAGTTCCAGGGC
AGAGTCACCATGACCGGGGACACGTCCACGAGCACAGTCTACATGGAGCTGAGCAGCCTGAGATC
TGAGGACACGGCCGTGTATTACTGTGCGAGAGGGGGGATAAAACTATGGTTACATTTTGACTATTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
```

TABLE III-continued

```
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 671

QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 672

26F12
CAGGTGCAGTTGGTGCAGTCTGGGGCTGAGGTGAAGAAGCCTGGGGCCTCAGTGAAGGTTTCCTGC
AAGGCATCTAGATACACCTTCACCAACTACTATATGTCCTGGGTGCGACAGGCCCCTGGACAAGGG
CTTGAGTGGATGGGAATAATCAACCCTAGTGGTGGTGACTCAACCTACGCACAGAAGTTCCAGGGC
AGACTCACCATGACCGGGGACACGTCCACGAGCACAGTCTACATGGAGCTGAGCAGCCTGAGATC
TGAGGACACGGCCGTGTATTACTGTGCGAGAGGGGGGATACAACTATGGTTACATTTTGACTACTG
GGGCCAGGGAACCCTGGTCACCGTCTCCTCAGCTTCCACCAAGGGCCCATCCGTCTTCCCCCTGG
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 673

QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 674
``` b: Light Chain Variable and Contant Region Polynucleotide and Amino acid Sequences

```
2G6
TCCTATGAACTGACTCAGCCACCCTCAGTGTCCGTGTCCCCAGGACAGACAGCCAGCATCACCTGC
TCTGGAGATAGGTTGGGGGAAAAATATACTTGCTGGTATCAGCAGAGGCCAGGCCAGTCCCCTTTG
CTGGTCATCTATCAAGATACCAAGCGGCCCTCAGGGATCCCTGAGCGATTCTCTGGCTCCAACTCT
GGTAACACAGCCACTCTGACCATCAGCGGGACCCAGGCTATGGATGAGGCTGACTATTACTGTCAG
GCGTGGGACAGCAGCACTGTGGTATTCGGCGGAGGGACCAAGCTGACCGTCCTAGGTCAGCCCAA
GGCCAACCCCACTGTCACTCTGTTCCCGCCCTCCTCTGAGGAGCTTCAAGCCAACAAGGCCACACT
AGTGTGTCTGATCAGTGACTTCTACCCGGGAGCTGTGACAGTGGCCTGGAAGGCAGATGGCAGCCC
CGTCAAGGCGGGAGTGGAGACCACCAAACCCTCCAAACAGAGCAACAACAAGTACGCGGCCAGCA
GCTACCTGAGCCTGACGCCCGAGCAGTGGAAGTCCCACAGAAGCTACAGCTGCCAGGTCACGCAT
GAAGGGAGCACCGTGGAGAAGACAGTGGCCCCTACAGAATGTTCATGA
SEQ ID NO: 675

SYELTQPPSVSVSPGQTASITCSGDRLGEKYTCWYQQRPGQSPLLVIYQDTKRPSGIPERFSGSNSGNTAT
LTISGTQAMDEADYYCQAWDSSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 676

4A2
GAAATTGTGTTGACGCAGTCTCCAGGCACCCTGTCTTTGTCTCCAGGGGAAAGAGCCACCCTCTCCT
GCAGGGCCAGTCGGAATATTAGCAGCAGCTACTTAGCCTGGTACCAGCAGAAACCTGGCCAGGCT
CCCAGGCTCCTCATCTATGGTGCCATCCAGCAGGGCCACTGGCATCCCAGACAGGTTCAGTGGCAGT
GGGTCTGGGACAGACTTCACTCTCACCATCAGCAGACTGGAGCCTGAAGATTTTACAGTGTATTAC
TGTCAGCAGTATGGTAGCTCATTCACTTTCGGCCCTGGGACCAAAGTGGATATCAAACGTACGGTG
GCTGCACCATCTGTCTTCATCTTCCCGCCATCTGATGAGCAGTTGAAATCTGGAACTGCCTCTGTTG
TGTGCCTGCTGAATAACTTCTATCCCAGAGAGGCCAAAGTACAGTGGAAGGTGGATAACGCCCTCC
AATCGGGTAACTCCCAGGAGAGTGTCACAGAGCAGGACAGCAAGGACAGCACCTACAGCCTCAGC
```

TABLE III-continued

```
AGCACCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGTTGA
SEQ ID NO: 677

EIVLTQSPGTLSLSPGERATLSCRASRNISSSYLAWYQQKPGQAPRLLIYGPSSRATGIPDRFSGSGSGTDF
TLTISRLEPEDFTVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 678

4A9
CAGTCTGTGCTGACGCAGCCGCCCTCAGTGTCTGGGGCCCCAGGACAGAGGGTCACCATCTCCTGC
ACTGGGAGCAGCTCCAACATCGGGACAGGTTATGCTGTACACTGGTACCAGCAGTTTCCAGGAACA
GCCCCCAAACTCCTCATCTATGGTAACAACAATCGGCCCTCAGGGGTTCCTGACCGATTCTCTGGCT
CCAAGTCTGGCACCTCAGCCTCCCTGGCCATCACTGGGCTCCAGGCTGAGGATGAGGCTGATTATT
ACTGCCAGTCCTATGACAGCAGACTGAGTGGTTGGGTGTTCGGCGGAGGGACCAAGCTGACCGTCC
TAGGTCAGCCCAAGGCCAACCCCACTGTCACTCTGTTCCCGCCCTCCTCTGAGGAGCTCCAAGCCA
ACAAGGCCACACTAGTGTGTCTGATCAGTGACTTCTACCCGGGAGCTGTGACAGTGGCCTGGAAGG
CAGATGGCAGCCCCGTCAAGGCGGGAGTGGAGACCACCAAACCCTCCAAACAGAGCAACAACAAG
TACGCGGCCAGCAGCTACCTGAGCCTGACGCCCGAGCAGTGGAAGTCCCACAGAAGCTACAGCTG
CCAGGTCACGCATGAAGGGAGCACCGTGGAGAAGACAGTGGCCCCTACAGAATGTTCATGA
SEQ ID NO: 679

QSVLTQPPSVSGAPGQRVTISCTGSSSNIGTGYAVHWYQQFPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 680

4B10
GAAATTGTATTGACGCAGTCTCCAGGCACCCTGTCTTTGTCTCCAGGGGAAAGAGCCACCCTCTCCT
GCAGGGCCAGTCAGAGTGTTAGCAACACCTACTTAGCCTGGTACCATCAGAGACCTGGCCAGGCTC
CCAGGCTCCTCATCTATGGTGCATCCAGCAGGGCCACTGGCATCCCAGACAGATTCAGTGGCAGTG
GGTCTGGGACAGACTTCGCTCTCACCATCAGCAGTCTGGAGCCTGAAGATTTTGCAGTGTATTACT
GTCAGCAGTACAGTAACTCGTGGACGTTCGGCCAAGGGACCAAGGTGGAAATCAAACGAACTGTG
GCTGCACCATCTGTCTTCATCTTCCCGCCATCTGATGAGCAGTTGAAATCTGGAACTGCCTCTGTTG
TGTGCCTGCTGAATAACTTCTATCCCAGAGAGGCCAAAGTACAGTGGAAGGTGGATAACGCCCTCC
AATCGGGTAACTCCCAGGAGAGTGTCACAGAGCAGGACAGCAAGGACAGCACCTACAGCCTCAGC
AGCACCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGTTGA
SEQ ID NO: 681

EIVLTQSPGTLSLSPGERATLSCRASQSVSNTYLAWYHQRPGQAPRLLIYGASSRATGIPDRFSGSGSGTD
FALTISSLEPEDFAVYYCQQYSNSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 682

4F3
GAAATTGTGTTGACGCAGTCTCCAGGCACCCTGTCTTTGTCTCCAGGGGAAAGAGCCACCCTCTCCT
GCAGGGCCAGTCAGAGTGTTAGCAGCAGCTACTTAGCCTGGTACCAGCAGAAACCTGGCCAGGCT
CCCAGGCTCCTCATCTATGGTGCATCCAGCAGGGCCACTGGCATCCCAGACAGGTTCAGTGGCAGT
GGGTCTGGGACAGACTTCACTCTCACCATCAGCAGACTGGAACCTGAGGATTTTGCAGTGTATTAC
TGTCAGCAGTATGGTAGCTCGTGGACGTTCGGCCAAGGGACCAAGGTGGAAATCAAACGTACGGT
GGCTGCACCATCTGTCTTCATCTTCCCGCCATCTGATGAGCAGTTGAAATCTGGAACTGCCTCTGTT
GTGTGCCTGCTGAATAACTTCTATCCCAGAGAGGCCAAAGTACAGTGGAAGGTGGATAACGCCCTC
CAATCGGGTAACTCCCAGGAGAGTGTCACAGAGCAGGACAGCAAGGACAGCACCTACAGCCTCAG
CAGCACCCTGACGCTGAGCAAAGCAGACTACGAGAAACACAAAGTCTACGCCTGCGAAGTCACCC
ATCAGGGCCTGAGCTCGCCCGTCACAAAGAGCTTCAACAGGGGAGAGTGTTGA
SEQ ID NO: 683

EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 684

4F7
CAGTCTGTGCTGACGCAGCCGCCCTCAGTGTCTGGGGCCCCAGGGCAGAGGGTCACCATCTCCTGC
ACTGGGAGCAGCTCCAATATCGGGACAGGTTATGATGTACACTGGTATCAGCAGCTTCCAGGAACA
GCCCCCAAACTCCTCATCCATGGTAACAGCAATCGGCCCTCAGGGGTCCCTGACCGATTCTCTGGC
TCCAAGTCTGGCACCTCAGCCTCCCTGGCCATCACTGGGCTCCAGGCTGAGGATGAGGCTGATTAT
TACTGCCAGTCCTATGACAGCAGTCTGAGTGGTTGGGTGTTCGGCGGAGGGACCAGGTTGACCGTC
CTAGGTCAGCCCAAGGCCAACCCCACTGTCACTCTGTTCCCGCCCTCCTCTGAGGAGCTCCAAGCC
AACAAGGCCACACTAGTGTGTCTGATCAGTGACTTCTACCCGGGAGCTGTGACAGTGGCCTGGAAG
GCAGATGGCAGCCCCGTCAAGGCGGGAGTGGAGACCACCAAACCCTCCAAACAGAGCAACAACAA
```

TABLE III-continued

```
GTACGCGGCCAGCAGCTACCTGAGCCTGACGCCCGAGCAGTGGAAGTCCCACAGAAGCTACAGCT
GCCAGGTCACGCATGAAGGGAGCACCGTGGAGAAGACAGTGGCCCCTACAGAATGTTCATGA
SEQ ID NO: 685

QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYDSSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 686

16A4
GAAATTGTGTTGACGCAGTCTCCAGGCACCCTGTCTTTGTCTCCAGGGGAAAGAGCCACCCTCTCCT
GCAGGGCCAGTCAGAGTGTTAGCAGCAGTTATTTAGCCTGGTACCAGCAGAAACCTGGCCAGGCTC
CCAGGCTCCTCATCTATGGTACATCCAGCAGGGCCACTGGCATCCCAGACAGGTTCAGTGGCAGTG
GGTCTGGGACAGACTTCACTCTCACCATCAGCAGACTGGAGCCTGAAGATTTTGCAGTGTATTATT
GTCAGCAGTACGGTAGCTCACCTTTCACTTTCGGCGGAGGGACCAAGGTGGAGATCAAACGAACTG
TGGCTGCACCATCTGTCTTCATCTTCCCGCCATCTGATGAGCAGTTGAAATCTGGTACCGCCTCTGT
TGTGTGCCTGCTGAATAACTTCTATCCCAGAGAGGCCAAAGTACAGTGGAAGGTGGATAACGCCCT
CCAATCGGGTAACTCCCAGGAGAGTGTCACAGAGCAGGACAGCAAGGACAGCACCTACAGCCTCA
GCAGCACCCTGACGCTGAGCAAAGCAGACTACGAGAAACACAAAGTCTACGCCTGCGAAGTCACC
CATCAGGGCCTGAGCTCGCCCGTCACAAAGAGCTTCAACAGGGGAGAGTGTTGA
SEQ ID NO: 687

EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 688

16C1
GAAATTGTGTTGACGCAGTCTCCAGGCACCCTGTCTTTGTCTCCAGGGGAAAGAGCCACCCTCTCCT
GCAGGGCCAGCCAGAGTGTTAGCAGCAGCTACTTAGCCTGGTACCAGCAGAAACCTGGCCAGGCT
CCCAGGCTCCTCATCTTTGGTGCATCCAGCAGGGCCACTGGCATCCCAGACAGGTTCAGTGGCAGT
GGGTCTGGGACAGACTTCACTCTCACCATCAGCGGACTGGAGCCTGAAGATTTTGCAGTGTATCAC
TGTCAGCAGTATGGTAACTCACCGCTCACTTTCGGCGGAGGGACCAAGGTGGAGATCAAACGAACT
GTGGCTGCACCATCTGTCTTCATCTTCCCGCCATCTGATGAGCAGTTGAAATCTGGTACCGCCTCTG
TTGTGTGCCTGCTGAATAACTTCTATCCCAGAGAGGCCAAAGTACAGTGGAAGGTGGATAACGCCC
TCCAATCGGGTAACTCCCAGGAGAGTGTCACAGAGCAGGACAGCAAGGACAGCACCTACAGCCTC
AGCAGCACCCTGACGCTGAGCAAAGCAGACTACGAGAAACACAAAGTCTACGCCTGCGAAGTCAC
CCATCAGGGCCTGAGCTCGCCCGTCACAAAGAGCTTCAACAGGGGAGAGTGTTGA
SEQ ID NO: 689

EIVLTQSPGTLSLSPGERATLSCRASQSVSSSYLAWYQQKPGQAPRLLIFGASSRATGIPDRFSGSGSGTD
FTLTISGLEPEDFAVYHCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 690

17H8
GACATTGTATTGACGCAGTCTCCAGGCACCCTGTCTTTGTCTCCAGGGGAAAGAGCCACCCTCTCCT
GCAGGGCCAGTCAGAGTGTTGCCGGCAGCTACCTAGCCTGGTACCAGCAGAAACCTGGCCAGGCT
CCCAGGCTCCTCATCTCTGGTGCATCCAGCAGGGCCACTGGCATCCCAGACAGGTTCAGTGGCAGT
GGGTCTGGGACAGACTTCACTCTCACCATCAGCAGACTGGAGCCTGAAGATTTTGCAGTGTATTAC
TGTCAGCAGTATGGTAAATCACCGATCACCTTCGGCCAAGGGACACGACTGGAGATGAAAGGAAC
TGTGGCTGCACCATCTGTCTTCATCTTCCCGCCATCTGATGAGCAGTTGAAATCTGGTACCGCCTCT
GTTGTGTGCCTGCTGAATAACTTCTATCCCAGAGAGGCCAAAGTACAGTGGAAGGTGGATAACGCC
CTCCAATCGGGTAACTCCCAGGAGAGTGTCACAGAGCAGGACAGCAAGGACAGCACCTACAGCCT
CAGCAGCACCCTGACGCTGAGCAAAGCAGACTACGAGAAACACAAAGTCTACGCCTGCGAAGTCA
CCCATCAGGGCCTGAGCTCGCCCGTCACAAAGAGCTTCAACAGGGGAGAGTGTTGA
SEQ ID NO: 691

DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKGTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 692

19B5
CAGTCTGCGCTGACTCAGCCACCCTCAACGACTGGGACCCCCGGGCAGAGGGTCACCATCTCTTGT
TCTGGAAGCAGGTCCAACATCGGAAGCAATTTTGTAAACTGGTACCAAGCAGCTCCCAGGAACGGC
CCCCAAAGTCCTCATCTATACTAATAATCAGCGGCCCTCAGGGGTCCCTGACCGATTCTCTGGCTCC
AAGTCTGGCACCTCAGCCTCCCTGGCCATCAGTGGGCTCCAGTCTGAGGATGAGTCTGATTATTACT
GCGCAACATGGGATGACAGTATGAATGTTGGGTGTTCGGCGGAGGGACCAAACTGACCGTCCTA
GGTCAGCCCAAGGCTGCCCCCTCGGTCACTCTGTTCCCACCCTCCTCTGAGGAGCTTCAAGCCAAC
AAGGCCACACTGGTGTGTCTCATAAGTGACTTCTACCCGGGAGCCGTGACAGTGGCCTGGAAGGCA
GATAGCAGCCCCGTCAAGGCGGGAGTGGAGACCACCACACCCTCCAAACAAAGCAACAACAAGTA
```

TABLE III-continued

CGCGGCCAGCAGCTATCTGAGCCTGACGCCTGAGCAGTGGAAGTCCCACAGAAGCTACAGCTGCC
AGGTCACGCATGAAGGGAGCACCGTGGAGAAGACAGTGGCCCCTACAGAATGTTCATGA
SEQ ID NO: 693

QSALTQPPSTTGTPGQRVTISCSGSRSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 694

20D3
CAGTCTGCGCTGACTCAGCCACCCTCAGCGACTGGGACCCCCGGGCAGAGGGTCACCATCTCTTGT
TCTGGAAGCAGCTCCAACATCGGAAGCAATTTTGTAAACTGGTACAAGCAGCTCCCAGGAACGGCC
CCCAAAGTCCTCATCTATACTAATAATCAGCGGCCCTCAGGGGTCCCTGACCGATTCTCTGGCTCCA
AGTCTGGCACCTCAGCCTCCCTGGCCATCAGTGGGCTCCAGTCTGAGGATGAGTCTGATTATTACTG
TGCAACATGGGATGACAGCCTGAATGGTTGGGTGTTCGGCGGAGGGACCAAGCTGACCGTCCTAG
GTCAGCCCAAGGCTGCCCCCTCGGTCACTCTGTTCCCACCCTCCTCTGAGGAGCTTCAAGCCAACA
AGGCCACACTGGTGTGTCTCATAAGTGACTTCTACCCGGGAGCCGTGACAGTGGCCTGGAAGGCAG
ATAGCAGCCCCGTCAAGGCGGGAGTGGAGACCACCACACCCTCCAAACAAAGCAACAACAAGTAC
GCGGCCAGCAGCTATCTGAGCCTGACGCCTGAGCAGTGGAAGTCCCACAGAAGCTACAGCTGCCA
GGTCACGCATGAAGGGAGCACCGTGGAGAAGACAGTGGCCCCTACAGAATGTTCATGA
SEQ ID NO: 695

QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 696

22D1
CAGTCTGCGCTGACTCAGCCACCCTCAGCGACTGGGACCCCCGGGCAGAGGGTCACCATCTCTTGT
TCTGGAAGCAGCTCCAACATCGGAAGCAATTTTGTAAACTGGTACAAGCAGCTCCCAGGAACGGCC
CCCAAAGTCCTCATCTATACTAATAATCAGCGGCCCTCAGGGGTCCCTGACCGATTCTCTGGCTCCA
AGTCTGGCACCTCAGCCTCCCTGGCCATCAGTGGGCTCCAGTCTGAGGATGAGTCTGATTATTACTG
TGCAACATGGGATGACAGTATGAATGGTTGGGTGTTCGGCGGAGGGACCAAGCTGACCGTCCTAG
GTCAGCCCAAGGCTGCCCCCTCGGTCACTCTGTTCCCACCCTCCTCTGAGGAGCTTCAAGCCAACA
AGGCCACACTGGTGTGTCTCATAAGTGACTTCTACCCGGGAGCCGTGACAGTGGCCTGGAAGGCAG
ATAGCAGCCCCGTCAAGGCGGGAGTGGAGACCACCACACCCTCCAAACAAAGCAACAACAAGTAC
GCGGCCAGCAGCTATCTGAGCCTGACGCCTGAGCAGTGGAAGTCCCACAGAAGCTACAGCTGCCA
GGTCACGCATGAAGGGAGCACCGTGGAGAAGACAGTGGCCCCTACAGAATGTTCATGA
SEQ ID NO: 697

QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 698

22G10
GAAATAGTGATGACGCAGTCTCCAGTCACCCTGTCTCTGTCTCTAGGGGAAAGAGCCACCCTCTCC
TGCAGGGCCAGTCAGAGTATTAGCAGCAACTTAGCCTGGTTCCAGCAGAAACCTGGCCAGGCTCCC
AGACTCCTCATCTATGGTGCATTTACCAGGGCCACTGGTATCCCAGCCAGGTCAGTGGCAGTGGG
TCTGGGACAGAGTTCACTCTCACCATCAGCAGCCTGCAGTCTGAAGATTTTGCAGTTTATTACTGTC
AGCAGTATAATTACTGGCCGCTCACTTTCGGCGGAGGGACCAAGGTGGAGATCAAGCGAACTGTG
GCTGCACCATCTGTCTTCATCTTCCCGCCATCTGATGAGCAGTTGAAATCTGGTACCGCCTCTGTTG
TGTGCCTGCTGAATAACTTCTATCCCAGAGAGGCCAAAGTACAGTGGAAGGTGGATAACGCCCTCC
AATCGGGTAACTCCCAGGAGAGTGTCACAGAGCAGGACAGCAAGGACAGCACCTACAGCCTCAGC
AGCACCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGTTGA
SEQ ID NO: 699

EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 700

23A10
TCCTATGAGCTGACTCAGCCACCCTCAGTGTCCGTGTCCCCAGGACAGACAGCCAGCATCACCTGC
TCTGGAGATAGATTGGGGGAGAAATATGTTTGCTGGTATCAGCAGAAGCCAGGCCAGTCCCCTATA
CTGGTCATCTATCAAGATAATAAGTGGCCCTCAGGGATCCCTGAGCGATTCTCTGGCTCCAACTCTG
GGAACACAGCCACTCTGACCATCAGCGGGACCCAGGCTATGGATGAGGCTGACTATTACTGTCAGG
CGTGGGACAGCAGCACTGTGGTATTCGGCGGGGGGACCAAGCTGACCGTCCTAGGTCAGCCCAAG
GCTGCCCCCTCGGTCACTCTGTTCCCACCCTCCTCTGAGGAGCTTCAAGCCAACAAGGCCACACTG
GTGTGTCTCATAAGTGACTTCTACCCCGGGAGCCGTGACAGTGGCCTGGAAGGCAGATAGCAGCCCC

TABLE III-continued

GTCAAGGCGGGAGTGGAGACCACCACACCCTCCAAACAAAGCAACAACAAGTACGCGGCCAGCAG
CTATCTGAGCCTGACGCCTGAGCAGTGGAAGTCCCACAGAAGCTACAGCTGCCAGGTCACGCATGA
AGGGAGCACCGTGGAGAAGACAGTGGCCCCTACAGAATGTTCATGA
SEQ ID NO: 701

SYELTQPPSVSVSPGQTASITCSGDRLGEKYVCWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 702

25F8
CAGTCTGCGCTGACTCAGCCACCCTCAGCGACTGGGACCCCCGGGCAGAGGGTCACCATCTCTTGT
TCTGGAAGCAGCTCCAACATCGGAAGGAATTTTGTAAACTGGTATAAGCAGCTCCCAGGAACGGCC
CCCAAAGTCCTCATTTATACTAATAATCAGCGGCCCTCAGGGGTCCCTGACCGATTCTCTGGCTCCA
AGTCTGGCACCTCAGCCTCCCTGGCCATCAGTGGGCTCCAGTCTGAGGATGAGTCTGATTATTACTG
TGCAGCATGGGATGACAGCCTGAATGGTTGGGTGTTCGGCGGAGGGACCAAGCTGACCGTCCTAG
GTCAGCCCAAGGCTGCCCCCTCGGTCACTCTGTTCCCACCCTCCTCTGAGGAGCTTCAAGCCAACA
AGGCCACACTGGTGTGTCTCATAAGTGACTTCTACCCGGGAGCCGTGACAGTGGCCTGGAAGGCAG
ATAGCAGCCCCGTCAAGGCGGGAGTGGAGACCACCACACCCTCCAAACAAAGCAACAACAAGTAC
GCGGCCAGCAGCTATCTGAGCCTGACGCCTGAGCAGTGGAAGTCCCACAGAAGCTACAGCTGCCA
GGTCACGCATGAAGGGAGCACCGTGGAGAAGACAGTGGCCCCTACAGAATGTTCATGA
SEQ ID NO: 703

QSALTQPPSATGTPGQRVTISCSGSSSNIGRNFVNWYKQLPGTAPKVLIYTNNQRPSGVPDRFSGSKSGT
SASLAISGLQSEDESDYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 704

25G10
GAAATTGTGTTGACGCAGTCTCCAGGCACCCTGTCTTTGTCTCCAGGGGAAAGAGCCACCCTCTCCT
GCAGGGCCAGTCAGAGTGTTAGCAGCAGCTACTTAGCCTGGTACCAGCAGAAACCTGGCCAGGCT
CCCAGGCTCCTCATCTTTGGTGCATCCAGCAGGGCCACTGGCATCCCAGACAGGTTCAGTGGCAGT
GGGTCTGGGACAGACTTCACTCTCACCATCAGCAGACTGGAGCCTGAAGATTTTGCAGTGTATCAC
TGTCAGCAGTATGGTAACTCACCGCTCACTTTCGGCGGAGGGACCAAGGTGGAGATCAAACGAACT
GTGGCTGCACCATCTGTCTTCATCTTCCCGCCATCTGATGAGCAGTTGAAATCTGGTACCGCCTCTG
TTGTGTGCCTGCTGAATAACTTCTATCCCAGAGAGGCCAAAGTACAGTGGAAGGTGGATAACGCCC
TCCAATCGGGTAACTCCCAGGAGAGTGTCACAGAGCAGGACAGCAAGGACAGCACCTACAGCCTC
AGCAGCACCCTGACGCTGAGCAAAGCAGACTACGAGAACACAAAGTCTACGCCTGCGAAGTCAC
CCATCAGGGCCTCGCCCGTCACAAAGAGCTTCAACAGGGGAGAGTGTTGA
SEQ ID NO: 705

EIVLTQSPGTLSLSPGERATLSCRASQSVSSSYLAWYQQKPGQAPRLLIFGASSRATGIPDRFSGSGSGTD
FTLTISRLEPEDFAVYHCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 706

26D1
CACTCTGTGCTGACTCAGTCACCCTCAGCGTCTGGGACCCCCGGACAGAGGGTCACCATCTCTTGTT
CTGGAAGCCGCTCCAACATCGGAAGTAATTTTGTAAACTGGTACCAGCAGCTCCCAGGAACGGCCC
CCAAACTCCTCATCTATACTAATAATCAGCGGCCCTCAGGGGTCCCTGACCGATTCTCTGGCTCCAA
GTCTGGCACCTCAGCCTCCCTGGCCATCAGTGGGCTCCAGTCTGAGGATGAGGCTGATTATTACTGT
GCAGTATGGGATGACAGCCTGAATGGTTGGGTGTTCGGCGGAGGGACCAAGCTGACCGTCCTAGG
TCAGCCCAAGGCTGCCCCCTCGGTCACTCTGTTCCCACCCTCCTCTGAGGAGCTTCAAGCCAACAA
GGCCACACTGGTGTGTCTCATAAGTGACTTCTACCCGGGAGCCGTGACAGTGGCCTGGAAGGCAGA
TAGCAGCCCCGTCAAGGCGGGAGTGGAGACCACCACACCCTCCAAACAAAGCAACAACAAGTACG
CGGCCAGCAGCTATCTGAGCCTGACGCCTGAGCAGTGGAAGTCCCACAGAAGCTACAGCTGCCAG
GTCACGCATGAAGGGAGCACCGTGGAGAAGACAGTGGCCCCTACAGAATGTTCATGA
SEQ ID NO: 707

HSVLTQSPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 708

26F12
CAGTCTGTGCTGACTCAGTCACCCTCAGCGTCTGGGACCCCCGGGCAGAAGGTCACCATCTCTTGTT
CTGGAAGCCGCTCCAACATCGGAAGTAATTTTGTAAACTGGTACCAGCAGCTCCCAGGAACGGCCC
CCAAACTCCTCATCTATACTAATTATCAGCGGCCCTCAGGGGTCCCTGACCGATTCTCTGGCTCCAA
GTCTGGCACCTCAGCCTCCCTGGCCATCAGTGGGCTCCAGTCTGAGGATGAGGCTGATTATTACTGT
GCAGTATGGGATGACAGCCTGAATGGTTGGGTGTTCGGCGGAGGGACCAAGCTGACCGTCCTAGG
TCAGCCCAAGGCTGCCCCCTCGGTCACTCTGTTCCCACCCTCCTCTGAGGAGCTTCAAGCCAACAA
GGCCACACTGGTGTGTCTCATAAGTGACTTCTACCCGGGAGCCGTGACAGTGGCCTGGAAGGCAGA
TAGCAGCCCCGTCAAGGCGGGAGTGGAGACCACCACACCCTCCAAACAAAGCAACAACAAGTACG

TABLE III-continued

```
CGGCCAGCAGCTATCTGAGCCTGACGCCTGAGCAGTGGAAGTCCCACAGAAGCTACAGCTGCCAG
GTCACGCATGAAGGGAGCACCGTGGAGAAGACAGTGGCCCCTACAGAATGTTCATGA
SEQ ID NO: 709

QSVLTQSPSASGTPGQKVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 710
``` c: Heavy Chain Variable and Contant Region Polynucleotide and Amino acid Sequences

```
13586_HC [hu anti-<huCDH19> 4F3 VH]::huIgG1z
QVQLVESGGGVVQPGRSLRLSCAASGFSFSSYDMDWVRQTPGKGLEWVAVIWYDGSNKYYADSVRG
RFTISRDNSKNTLFLQMNSLRVEDTAVYYCARETGEGWYFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 711

13589_HC [hu anti-<huCDH19> 4A9 VH]::huIgG1z
QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 712

13590_HC [hu anti-<huCDH19> 4B10 VH]::huIgG1z
QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 713

13874_HC [hu anti-<huCDH19> 17H8.2 VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 714

13875_HC [hu anti-<huCDH19> 16C1.1 VH]::huIgG1z
QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 715

13876_HC [hu anti-<huCDH19> 16A4.1 VH]::huIgG1z
QVQLQESGPGLAKPSETLSLTCTVSGDSITSYYWSWIRQPPGKGLEWIGYIYYSGSTNYNPSLKSRVTISV
DTSKNQFSLKLSSVTAADTAVYYCARDQRRIAAAGTHFYGMDVWGQGTTVTVSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 716

13877_HC [hu anti-<huCDH19> 22G10.1 VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
```

TABLE III-continued

SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 717

13878_HC [hu anti-<huCDH19> 20D3.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 718

13879_HC [hu anti-<huCDH19> 22D1.1 VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 719

13880_HC [hu anti-<huCDH19> 25F8.1 VH]::huIgG1z
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 720

13881_HC [hu anti-<huCDH19> 26F12.1 VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 721

13882_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 722

13883_HC [hu anti-<huCDH19> 25G10.1 VH]::huIgG1z
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 723

13885_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 724

14022_HC [hu anti-<huCDH19> 4A2 VH]::huIgG1z
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG TABLE III-continued QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 725

14024_HC [hu anti-<huCDH19> 4A2 (1-472)(Q17E,H47P)
VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCARDGSSGWYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 726

14025_HC [hu anti-<huCDH19> 4A2 VH]::huIgG1z
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 727

14026_HC [hu anti-<huCDH19> 4A2 (1-472)(Q17E,H47P)
VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCARDGSSGWYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 728

14027_HC [hu anti-<huCDH19> 4A2 (1-472)(Q17E,H47P,
D111E) VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCAREGSSGWYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 729

14028_HC [hu anti-<huCDH19> 4A2 (1-472)(Q17E,H47P,
D111E,W134Y) VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCAREGSSGYYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 730

14029_HC [hu anti-<huCDH19> 4A2 VH]::huIgG1z
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 731

14030_HC [hu anti-<huCDH19> 4F3 (1-471)(R17G)
VH]::huIgG1z
QVQLVESGGGVVQPGGSLRLSCAASGFSFSSYDMDWVRQTPGKGLEWVAVIWYDGSNKYYADSVRG
RFTISRDNSKNTLFLQMNSLRVEDTAVYYCARETGEGWYFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV TABLE III-continued

```
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 732

14031_HC [hu anti-<huCDH19> 4F3 (1-471)(R17G,T47A)
VH]::huIgG1z
QVQLVESGGGVVQPGGSLRLSCAASGFSFSSYDMDWVRQAPGKGLEWVAVIWYDGSNKYYADSVRG
RFTISRDNSKNTLFLQMNSLRVEDTAVYYCARETGEGWYFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 733

14032_HC [hu anti-<huCDH19> 4F3 (1-471)(R17G,T47A,
R141Q) VH]::huIgG1z
QVQLVESGGGVVQPGGSLRLSCAASGFSFSSYDMDWVRQAPGKGLEWVAVIWYDGSNKYYADSVRG
RFTISRDNSKNTLFLQMNSLRVEDTAVYYCARETGEGWYFDLWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 734

14033_HC [hu anti-<huCDH19> 4F3 (1-471)(R17G,T47A,
D61E,D72E,R141Q) VH]::huIgG1z
QVQLVESGGGVVQPGGSLRLSCAASGFSFSSYDMDWVRQAPGKGLEWVAVIWYEGSNKYYAESVRG
RFTISRDNSKNTLFLQMNSLRVEDTAVYYCARETGEGWYFDLWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 735

14034_HC [hu anti-<huCDH19> 4F3 (1-471)(R17G,T47A,
D61E,D72E,W134Y,R141Q) VH]::huIgG1z
QVQLVESGGGVVQPGGSLRLSCAASGFSFSSYDMDWVRQAPGKGLEWVAVIWYEGSNKYYAESVRG
RFTISRDNSKNTLFLQMNSLRVEDTAVYYCARETGEGYYFDLWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 736

14039_HC [hu anti-<huCDH19> 2G6 (1-477)(R17G,D61E,
D72E,K94N) VH]::huIgG1z
QVQLVESGGGVVQPGGSLRLSCAASGFTFSSYGMHWVRQAPGKGLEWVAFIWYEGSNKYYAESVKD
RFTISRDNSKNTLYLQMNSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 737

14040_HC [hu anti-<huCDH19> 16C1.1 VH]::huIgG1z
QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 738

14041_HC [hu anti-<huCDH19> 16C1.1 (1-469)(T92K)
VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
```

TABLE III-continued

NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 739

14042_HC [hu anti-<huCDH19> 16C1.1 (1-469)(T92K,
D109E) VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCAREGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 740

14043_HC [hu anti-<huCDH19> 16C1.1 (1-469)(T92K,
W132Y,W135Y) VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGYYRYFDPWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKP
SNTKVDKKVEPKSCDKTHTCPPCPAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKAKGQP
REPQVYTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK
SEQ ID NO: 741

14044_HC [hu anti-<huCDH19> 16C1.1 (1-469)(T92K)
VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 742

14045_HC [hu anti-<huCDH19> 17H8.2 VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 743

14046_HC [hu anti-<huCDH19> 17H8.2 (1-471)(D109E)
VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGWYDAFDIWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 744

14047_HC [hu anti-<huCDH19> 17H8.2 (1-471)(D109E,
W132Y) VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGYYDAFDIWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 745

14048_HC [hu anti-<huCDH19> 17H8.2 (1-471)(D109E)
VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGWYDAFDIWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK

TABLE III-continued

```
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 746

14049_HC [hu anti-<huCDH19> 4F7 VH]::huIgG1z
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 747

14050_HC [hu anti-<huCDH19> 4F7 VH]::huIgG1z
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 748

14051_HC [hu anti-<huCDH19> 4F7 (1-468)(W113Y)
VH]::huIgG1z
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNYAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 749

14052_HC [hu anti-<huCDH19> 4B10 (1-471)(R17G,
D61E,D72E,W134Y) VH]::huIgG1z
QVQLVESGGGVVQPGGSLRLSCAASGFTFSSYDMHWVRQAPGKGLEWVAVISYEGTNEYYAESVKGR
FTISRDTSKNTLYLQMNSLRAEDTAVYYCARERYFDYSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 750

14053_HC [hu anti-<huCDH19> 4B10 VH]::huIgG1z
QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 751

14054_HC [hu anti-<huCDH19> 4B10 (1-471)(R17G)
VH]::huIgG1z
QVQLVESGGGVVQPGGSLRLSCAASGFTFSSYDMHWVRQAPGKGLEWVAVISYDGTNEYYADSVKG
RFTISRDTSKNTLYLQMNSLRAEDTAVYYCARERYFDWSFDYWGQGTLVSVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 752

14055_HC [hu anti-<huCDH19> 4B10 (1-471)(R17G,
D61E,D72E) VH]::huIgG1z
QVQLVESGGGVVQPGGSLRLSCAASGFTFSSYDMHWVRQAPGKGLEWVAVISYEGTNEYYAESVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
```

TABLE III-continued

KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 753

14056_HC [hu anti-<huCDH19> 4A9 VH]::huIgG1z
QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 754

14057_HC [hu anti-<huCDH19> 4A9 (1-468)(F55I,A56G)
VH]::huIgG1z
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 755

14058_HC [hu anti-<huCDH19> 4A9 (1-468)(F55I,A56G)
VH]::huIgG1z
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 756

14059_HC [hu anti-<huCDH19> 4A9 (1-468)(F55I,A56G,
W113Y) VH]::huIgG1z
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNYAFHFDFWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 757

14060_HC [hu anti-<huCDH19> 20D3.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 758

14061_HC [hu anti-<huCDH19> 20D3.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 759

14062_HC [hu anti-<huCDH19> 20D3.1 (1-469)(W133Y)
VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV TABLE III-continued KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 760

14063_HC [hu anti-<huCDH19> 20D3.1 (1-469)(W133Y)
VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 761

14064_HC [hu anti-<huCDH19> 20D3.1 (1-469)(W133Y)
VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYCARGGIQLYLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 762

14065_HC [hu anti-<huCDH19> 22G10.1 (1-470)(S82R,
A99E) VH]::huIgG1z
EVQLLESGGGLVQPGGSLRLSCAASGFTFSSYAMNWVRQAPGKGLEWVSTISGGGANTYYADSVKGR
FTISRDNSKSTLYLQMNSLRAEDTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 763

14066_HC [hu anti-<huCDH19> 22G10.1 (1-470)(A99E,
H105Y) VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYYCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 764

14067_HC [hu anti-<huCDH19> 22G10.1 (1-470)(A99E)
VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 765

14068_HC [hu anti-<huCDH19> 22G10.1 (1-470)(A99E)
VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 766

14069_HC [hu anti-<huCDH19> 22G10.1 (1-470)(D72E,
A99E) VH]::huIgG1z
EVQLLESGGGLVQPGGSLRLSCAASGFTFSSYAMNWVRQAPGKGLEWVSTISGGGANTYYAESVKGRF
TISSDNSKSTLYLQMNSLRAEDTAVYHCAKGGMGGYYYGMDVWGQGTTVTVSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP TABLE III-continued EVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 767

14070_HC [hu anti-<huCDH19> 22G10.1 (1-470)(H105Y)
VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAADTAVYYCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 768

14071_HC [hu anti-<huCDH19> 16A4.1 (1-474)(T144L)
VH]::huIgG1z
QVQLQESGPGLAKPSETLSLTCTVSGDSITSYYWSWIRQPPGKGLEWIGYIYYSGSTNYNPSLKSRVTISV
DTSKNQFSLKLSSVTAADTAVYYCARDQRRIAAAGTHFYGMDVWGQGTLVTVSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 769

14072_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 770

14073_HC [hu anti-<huCDH19> 19B5.1 (1-469)(W133Y)
VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 771

14074_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 772

14075_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 773

14076_HC [hu anti-<huCDH19> 19B5.1 (1-469)(W133Y)
VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 774

14077_HC [hu anti-<huCDH19> 23A10.3 (1-474)(L92Q)
VH]::huIgG1z
QVQLVESGGGVVQPGRSLRLSCAASGFTFSRYGIHWVRQAPGKGLEWVAVIWYDGSNKYYADSVKGR
FTISRDNSKNTLYLQMNSLRAEDSAVYYCARRAGIPGTTGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 775

14078_HC [hu anti-<huCDH19> 23A10.3 (1-474)(R17G,
L92Q) VH]::huIgG1z
QVQLVESGGGVVQPGGSLRLSCAASGFTFSRYGIHWVRQAPGKGLEWVAVIWYDGSNKYYADSVKG
RFTISRDNSKNTLYLQMNSLRAEDSAVYYCARRAGIPGTTGYYYGMDVWGQGTTVTVSSASTKGPSVF
PLAPSSKSTSGGTAALGCLVKDYFPEPVTVSWNSGALTSGVHTFPAVLQSSGLYSLSSVVTVPSSSLGTQ
TYICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 776

14079_HC [hu anti-<huCDH19> 23A10.3 (1-474)(R17G,
D61E,D72E,L92Q) VH]::huIgG1z
QVQLVESGGGVVQPGGSLRLSCAASGFTFSRYGIHWVRQAPGKGLEWVAVIWYEGSNKYYAESVKGR
FTISRDNSKNTLYLQMNSLRAEDSAVYYCARRAGIPGTTGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 777

14080_HC [hu anti-<huCDH19> 23A10.3 VH]::huIgG1z
QVQLVESGGGVVQPGRSLRLSCAASGFTFSRYGIHWVRQAPGKGLEWVAVIWYDGSNKYYADSVKGR
FTISRDNSKNTLYLLMNSLRAEDSAVYYCARRAGIPGTTGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 778

14081_HC [hu anti-<huCDH19> 25G10.1 VH]::huIgG1z
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 779

14082_HC [hu anti-<huCDH19> 25G10.1 (1-469)(D109E,
W132Y,W135Y) VH]::huIgG1z
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCAREGSSGYYRYFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 780

14083_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE TABLE III-continued VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 781

14084_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 782

14085_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 783

14086_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 784

14087_HC [hu anti-<huCDH19> 26D1.1 (1-469)(W133Y)
VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLYLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 785

14088_HC [hu anti-<huCDH19> 26D1.1 (1-469)(R27G,
G82R) VH]::huIgG1z
QVQLVQSGAEVKKPGASVKVSCKASGYTFTSYYMSWVRQAPGQGLEWMGIIHPSGGDTTYAQKFQGR
VTMTRDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 786

14089_HC [hu anti-<huCDH19> 26F12.1 VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 787

14090_HC [hu anti-<huCDH19> 26F12.1 VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV TABLE III-continued NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 788

14091_HC [hu anti-<huCDH19> 26F12.1 (1-469)(W133Y)
VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLYLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 789

14092_HC [hu anti-<huCDH19> 26F12.1 (1-469)(W133Y)
VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLYLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 790

14093_HC [hu anti-<huCDH19> 25F8.1 VH]::huIgG1z
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 791

14094_HC [hu anti-<huCDH19> 25F8.1 VH]::huIgG1z
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 792

14095_HC [hu anti-<huCDH19> 25F8.1 (1-469)(F90Y)
VH]::huIgG1z
QVQLVQSGAEVKKPGASVKVSCKASGYTFTSYYIHWVRQAPGQGLEWMGIINPSGGSTRYAQKFQGR
VTMTRDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 793

14096_HC [hu anti-<huCDH19> 25F8.1 (1-469)(F90Y)
VH]::huIgG1z
QVQLVQSGAEVKKPGASVKVSCKASGYTFTSYYIHWVRQAPGQGLEWMGIINPSGGSTRYAQKFQGR
VTMTRDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 794

14097_HC [hu anti-<huCDH19> 25F8.1 (1-469)(F90Y,
W133Y) VH]::huIgG1z
QVQLVQSGAEVKKPGASVKVSCKASGYTFTSYYIHWVRQAPGQGLEWMGIINPSGGSTRYAQKFQGR
VTMTRDTSTSTVYMELSSLRSEDTAVYYCARGGIQLYLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV TABLE III-continued KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 795

14098_HC [hu anti-<huCDH19> 22D1.1 VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 796

14099_HC [hu anti-<huCDH19> 22D1.1 VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 797

14100_HC [hu anti-<huCDH19> 22D1.1 (1-469)(W133Y)
VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 798

14101_HC [hu anti-<huCDH19> 22D1.1 (1-469)(W133Y)
VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 799

14102_HC [hu anti-<huCDH19> 22D1.1 (1-469)(F90Y)
VH]::huIgG1z
QVQLVQSGAEVKKPGASVRVSCKVSGYTFTSYFIHWVRQAPGQGLEWMGIINPISVSTSYAQKFQGRV
TMTRDTSTSTVYMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 800

13591_HC [hu anti-<huCDH19> 4F7 VH]::huIgG1z
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 801

14301_HC [hu anti-<huCDH19> 2G6 VH]::huIgG1z
QVQLVESGGGVVQPGRSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS TABLE III-continued

```
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 802

14302_HC [hu anti-<huCDH19> 2G6 (1-477)(R17G,K94N)
VH]::huIgG1z
QVQLVESGGGVVQPGGSLRLSCAASGFTFSSYGMHWVRQAPGKGLEWVAFIWYDGSNKYYADSVKD
RFTISRDNSKNTLYLQMNSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 803

14303_HC [hu anti-<huCDH19> 2G6 (1-477)(D61E,D72E)
VH]::huIgG1z
QVQLVESGGGVVQPGRSLRLSCAASGFTFSSYGMHWVRQAPGKGLEWVAFIWYEGSNKYYAESVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 804

14304_HC [hu anti-<huCDH19> 2G6 (1-477)(R17G)
VH]::huIgG1z
QVQLVESGGGVVQPGGSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 805
``` d: Light Chain Variable and Contant Region Polynucleotide and Amino acid Sequences

```
13586_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 806

13589_LC [hu anti-<huCDH19> 4A9 VL]::huLLC-C1
QSVLTQPPSVSGAPGQRVTISCTGSSSNIGTGYAVHWYQQFPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 807

13590_LC [hu anti-<huCDH19> 4B10 VL]::huKLC
EIVLTQSPGTLSLSPGERATLSCRASQSVSNTYLAWYHQRPGQAPRLLIYGASSRATGIPDRFSGSGSGTD
FALTISSLEPEDFAVYYCQQYSNSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 808

13874_LC [hu anti-<huCDH19> 17H8.2 VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKGTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 809

13875_LC [hu anti-<huCDH19> 16C1.1 VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYHCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 810

13876_LC [hu anti-<huCDH19> 16A4.1 VL]::huKLC
EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGGGTKVEIKRTVAAPSVFIFPPSDEQLKSGTASVVCLLNNFYP
```

TABLE III-continued

REAKVQWKVDNALQSGNSQESVTEQDSKDSTYSLSSTLTLSKADYEKHKVYACEVTHQGLSSPVTKSF
NRGEC
SEQ ID NO: 811

13877_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 812

13878_LC [hu anti-<huCDH19> 20D3.1 VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 813

13879_LC [hu anti-<huCDH19> 22D1.1 VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 814

13880_LC [hu anti-<huCDH19> 25F8.1 VL]::huLLC-C2
QSALTQPPSATGTPGQRVTISCSGSSSNIGRNFVNWYKQLPGTAPKVLIYTNNQRPSGVPDRFSGSKSGT
SASLAISGLQSEDESDYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 815

13881_LC [hu anti-<huCDH19> 26F12.1
VL]::huLLC-C2
QSVLTQPSASGTPGQKVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 816

13882_LC [hu anti-<huCDH19> 26D1.1 VL]::huLLC-C2
HSVLTQPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 817

13883_LC [hu anti-<huCDH19> 25G10.1 VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYHCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 818

13885_LC [hu anti-<huCDH19> 19B5.1 VL]::huLLC-C2
QSALTQPPSTTGTPGQRVTISCSGSRSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 819

14022_LC [hu anti-<huCDH19> 4A2 (1-236)(N30Q)
VL]::huKLC
EIVLTQSPGTLSLSPGERATLSCRASRQISSSYLAWYQQKPGQAPRLLIYGPSSRATGIPDRFSGSGSGTDF
TLTISRLEPEDFTVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 820

14024_LC [hu anti-<huCDH19> 4A2 (1-236)(N30Q,
T102A,P141Q) VL]::huKLC

TABLE III-continued

```
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGQGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 821

14025_LC [hu anti-<huCDH19> 4A2 (1-236)(N30Q,
T102A) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGQGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 822

14026_LC [hu anti-<huCDH19> 4A2 (1-236)(N30Q,
T102A) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGQGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 823

14027_LC [hu anti-<huCDH19> 4A2 (1-236)(N30Q,
T102A,P141Q) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGQGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 824

14028_LC [hu anti-<huCDH19> 4A2 (1-236)(N30Q,
T102A,P141Q) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGQGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 825

14029_LC [hu anti-<huCDH19> 4A2 (1-236)(R29Q,N30S)
VL]::huKLC
EIVLTQSPGTLSLSPGERATLSCRASQSISSSYLAWYQQKPGQAPRLLIYGPSSRATGIPDRFSGSGSGTDF
TLTISRLEPEDFTVYYCQQYGSSFTFGQGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 826

14030_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 827

14031_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 828

14032_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 829

14033_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 830

14034_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
```

TABLE III-continued

REAKVQWKVDNALQSGNSQESVTEQDSKDSTYSLSSTLTLSKADYEKHKVYACEVTHQGLSSPVTKSF
NRGEC
SEQ ID NO: 831

14039_LC [hu anti-<huCDH19> 2G6 (1-234)(C42S,
D110E) VL]::huLLC-C1
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 832

14040_LC [hu anti-<huCDH19> 16C1.1 (1-235)(H105Y)
VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 833

14041_LC [hu anti-<huCDH19> 16C1.1 (1-235)(H105Y)
VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 834

14042_LC [hu anti-<huCDH19> 16C1.1 (1-235)(H105Y)
VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 835

14043_LC [hu anti-<huCDH19> 16C1.1 (1-235)(H105Y)
VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 836

14044_LC [hu anti-<huCDH19> 16C1.1 (1-235)(G95R,
H105Y,G141Q) VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 837

14045_LC [hu anti-<huCDH19> 17H8.2 (1-235)(G149R)
VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 838

14046_LC [hu anti-<huCDH19> 17H8.2 (1-235)(G149R)
VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 839

14047_LC [hu anti-<huCDH19> 17H8.2 (1-235)(G149R)
VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 840

14048_LC [hu anti-<huCDH19> 17H8.2 (1-235)(S57Y,
G149R) VL]::huKLC
DIVLTQSPGTLSLSPGERATLSCRASQSVAGSYLAWYQQKPGQAPRLLIYGASSRATGIPDRFSGSGSGT
DFTLTISRLEPEDFAVYYCQQYGKSPITFGQGTRLEMKRTVAAPSVFIFPPSDEQLKSGTASVVCLLNNF TABLE III-continued YPREAKVQWKVDNALQSGNSQESVTEQDSKDSTYSLSSTLTLSKADYEKHKVYACEVTHQGLSSPVTK
SFNRGEC
SEQ ID NO: 841

14049_LC [hu anti-<huCDH19> 4F7 (1-239)(I157Y)
VL]::huLLC-C2
QSVLTQPPSVSGAPGQRVTISCTGSSSNIGTGYDVHWYQQLPGTAPKLLIYGNSNRPSGVPDRFSGSKSG
TSASLAITGLQAEDEADYYCQSYDSSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 842

14050_LC [hu anti-<huCDH19> 4F7 (1-239)(H57Y,
D110E) VL]::huLLC-C2
QSVLTQPPSVSGAPGQRVTISCTGSSSNIGTGYDVHWYQQLPGTAPKLLIYGNSNRPSGVPDRFSGSKSG
TSASLAITGLQAEDEADYYCQSYESSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 843

14051_LC [hu anti-<huCDH19> 4F7 (1-239)(D110E)
VL]::huLLC-C2
QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYESSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 844

14052_LC [hu anti-<huCDH19> 4B10 (1-236)(H45Q,
A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 845

14053_LC [hu anti-<huCDH19> 4B10 (1-236)(H45Q,
A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 846

14054_LC [hu anti-<huCDH19> 4B10 (1-236)(H45Q,
A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 847

14055_LC [hu anti-<huCDH19> 4B10 (1-236)(H45Q,
A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 848

14056_LC [hu anti-<huCDH19> 4A9 (1-239)(F47L)
VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 849

14057_LC [hu anti-<huCDH19> 4A9 (1-239)(F47L)
VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 850

14058_LC [hu anti-<huCDH19> 4A9 (1-239)(F47L,
D110E) VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYESRLSGWVFGGGTKLTVLGQPKANPTVTLFPPSSEELQANKATLVC

TABLE III-continued

LISDFYPGAVTVAWKADGSPVKAGVETTKPSKQSNNKYAASSYLSLTPEQWKSHRSYSCQVTHEGSTV
EKTVAPTECS
SEQ ID NO: 851

14059_LC [hu anti-<huCDH19> 4A9 (1-239)(F47L,
D110E) VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYESRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 852

14060_LC [hu anti-<huCDH19> 20D3.1 (1-235)(S102A)
VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDEADYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 853

14061_LC [hu anti-<huCDH19> 20D3.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 854

14062_LC [hu anti-<huCDH19> 20D3.1 (1-235)(K45Q,
S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 855

14063_LC [hu anti-<huCDH19> 20D3.1 (1-235)(K45Q,
S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 856

14064_LC [hu anti-<huCDH19> 20D3.1 (1-235)(W109Y)
VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDESDYYCATYDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 857

14065_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 858

14066_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 859

14067_LC [hu anti-<huCDH19> 22G10.1 (1-234)(Q97E,
S98P) VL]::huKLC
EIVMTQSPVTLSLSLGERATLSCRASQSISSNLAWFQQKPGQAPRLLIYGAFTRATGIPARVSGSGSGTEF
TLTISSLEPEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 860

14068_LC [hu anti-<huCDH19> 22G10.1 (1-234)(V78F,
Q97E,S98P) VL]::huKLC

TABLE III-continued

EIVMTQSPVTLSLSLGERATLSCRASQSISSNLAWFQQKPGQAPRLLIYGAFTRATGIPARFSGSGSGTEF
TLTISSLEPEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 861

14069_LC [hu anti-<huCDH19> 22G10.1 (1-234)(V78F,
Q97E,S98P) VL]::huKLC
EIVMTQSPVTLSLSLGERATLSCRASQSISSNLAWFQQKPGQAPRLLIYGAFTRATGIPARFSGSGSGTEF
TLTISSLEPEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 862

14070_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 863

14071_LC [hu anti-<huCDH19> 16A4.1 (1-235)(G141Q)
VL]::huKLC
EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 864

14072_LC [hu anti-<huCDH19> 19B5.1 (1-235)(K45Q,
S102A) VL]::huLLC-C2
QSALTQPPSTTGTPGQRVTISCSGSRSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 865

14073_LC [hu anti-<huCDH19> 19B5.1 (1-235)(K45Q,
S102A) VL]::huLLC-C2
QSALTQPPSTTGTPGQRVTISCSGSRSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 866

14074_LC [hu anti-<huCDH19> 19B5.1 (1-235)(T11V,
K45Q,S102A) VL]::huLLC-C2
QSALTQPPSVTGTPGQRVTISCSGSRSNIGSNFVNWYQQLPGTAPKVLIYTNNQRPSGVPDRFSGSKSGT
SASLAISGLQSEDEADYYCATWDDSMNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 867

14075_LC [hu anti-<huCDH19> 19B5.1 (1-235)(T11V,
K45Q,S102A,D111E,N135Q) VL]::huLLC-C2
QSALTQPPSVTGTPGQRVTISCSGSRSNIGSNFVNWYQQLPGTAPKVLIYTNNQRPSGVPDRFSGSKSGT
SASLAISGLQSEDEADYYCATWDESMQGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 868

14076_LC [hu anti-<huCDH19> 19B5.1 (1-235)(T11V,
K45Q,S102A,W109Y,D111E,N135Q) VL]::huLLC-
C2
QSALTQPPSVTGTPGQRVTISCSGSRSNIGSNFVNWYQQLPGTAPKVLIYTNNQRPSGVPDRFSGSKSGT
SASLAISGLQSEDEADYYCATYDESMQGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 869

14077_LC [hu anti-<huCDH19> 23A10.3 (1-231)(C42S)
VL]::huLLC-C2
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 870

14078_LC [hu anti-<huCDH19> 23A10.3 (1-231)(C42S)
VL]::huLLC-C2

TABLE III-continued

SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 871

14079_LC [hu anti-<huCDH19> 23A10.3 (1-231)(C42S,
D110E) VL]::huLLC-C2
SYELTQPPSVSVSPGQTASITCSGDRLGEKYVSWYQQKPGQSPILVIYQDNKWPSGIPERFSGSNSGNTA
TLTISGTQAMDEADYYCQAWESSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 872

14080_LC [hu anti-<huCDH19> 23A10.3 (1-231)(C42Y)
VL]::huLLC-C2
SYELTQPPSVSVSPGQTASITCSGDRLGEKYVYWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 873

14081_LC [hu anti-<huCDH19> 25G10.1 (1-235)(H105Y)
VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 874

14082_LC [hu anti-<huCDH19> 25G10.1 (1-235)(H105Y)
VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 875

14083_LC [hu anti-<huCDH19> 26D1.1 (1-235)(S7P)
VL]::huLLC-C2
HSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 876

14084_LC [hu anti-<huCDH19> 26D1.1 (1-235)(H1Q,S7P) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 877

14085_LC [hu anti-<huCDH19> 26D1.1 (1-235)(H1Q,
S7P,W109Y) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 878

14086_LC [hu anti-<huCDH19> 26D1.1 (1-235)(H1Q,
S7P,W109Y,D111E,N135Q) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 879

14087_LC [hu anti-<huCDH19> 26D1.1 (1-235)(H1Q,
S7P,W109Y,D111E,N135Q) VL]::huLLC-C2

TABLE III-continued

QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 880

14088_LC [hu anti-<huCDH19> 26D1.1 (1-235)(H1Q,
S7P) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 881

14089_LC [hu anti-<huCDH19> 26F12.1 (1-235)(S7P)
VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 882

14090_LC [hu anti-<huCDH19> 26F12.1 (1-235)(S7P,
D111E) VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDESLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 883

14091_LC [hu anti-<huCDH19> 26F12.1 (1-235)(S7P,
D111E) VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDESLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 884

14092_LC [hu anti-<huCDH19> 26F12.1 (1-235)(S7P,
W109Y,D111E,N135Q) VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVYDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 885

14093_LC [hu anti-<huCDH19> 25F8.1 (1-235)(K45Q)
VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDESDYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 886

14094_LC [hu anti-<huCDH19> 25F8.1 (1-235)(K45Q,
S102A) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDEADYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 887

14095_LC [hu anti-<huCDH19> 25F8.1 (1-235)(K45Q,
S102A) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDEADYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 888

14096_LC [hu anti-<huCDH19> 25F8.1 (1-235)(K45Q,
S102A,D111E) VL]::huLLC-C2

TABLE III-continued

QSALTQPPSATGTPGQRVTISCSGSSSNIGRNFVNWYQQLPGTAPKVLIYTNNQRPSGVPDRFSGSKSGT
SASLAISGLQSEDEADYYCAAWDESLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 889

14097_LC [hu anti-<huCDH19> 25F8.1 (1-235)(K45Q,
S102A,D111E,N135Q) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDEADYYCAAWDESLQGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 890

14098_LC [hu anti-<huCDH19> 22D1.1 (1-235)(K45Q,
S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 891

14099_LC [hu anti-<huCDH19> 22D1.1 (1-235)(K45Q,
S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDESMQGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 892

14100_LC [hu anti-<huCDH19> 22D1.1 (1-235)(K45Q,
S102A,W109Y,D111E,N135Q) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATYDESMQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 893

14101_LC [hu anti-<huCDH19> 22D1.1 (1-235)(K45Q,
S102A,W109Y) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATYDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 894

14102_LC [hu anti-<huCDH19> 22D1.1 (1-235)(K45Q,
S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 895

13591_LC [hu anti-<huCDH19> 4F7 VL]::huLLC-C1
QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYDSSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 896

14301_LC [hu anti-<huCDH19> 2G6 (1-234)(D110E)
VL]::huLLC-C1
SYELTQPPSVSVSPGQTASITCSGDRLGEKYTCWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 897

14302_LC [hu anti-<huCDH19> 2G6 (1-234)(C42S,
D110E) VL]::huLLC-C1
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 898

14303_LC [hu anti-<huCDH19> 2G6 (1-234)(C42S,
D110E) VL]::huLLC-C1

TABLE III-continued

SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 899

14304_LC [hu anti-<huCDH19> 23A10.3 (1-231)(C42S)
VL]::huLLC-C2
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 900

TABLE IV

| Ab | Type | CDR 1 | CDR 2 | CDR 3 |
|---|---|---|---|---|
| a: HEAVY CHAIN CDRs | | | | |
| 14039 14303 | AA | SYGMH SEQ ID NO: 28 | FIWYEGSNKYYAESVKD SEQ ID NO: 901 | RAGIIGTIGYYYGMDV SEQ ID NO: 30 |
| 14027 | AA | SSGYYWS SEQ ID NO: 46 | YIYYTGSAYYNPSLKS SEQ ID NO: 47 | EGSSGWYFQY SEQ ID NO: 902 |
| 14028 | AA | SSGYYWS SEQ ID NO: 46 | YIYYTGSAYYNPSLKS SEQ ID NO: 47 | EGSSGYYFQY SEQ ID NO: 903 |
| 14059 | AA | GYYWS SEQ ID NO: 52 | YFSYSGSTNYNPSLKS SEQ ID NO: 53 | NYAFHFDF SEQ ID NO: 904 |
| 14052 | AA | SYDMH SEQ ID NO: 58 | VISYEGTNEYYAESVKG SEQ ID NO: 905 | ERYFDYSFDY SEQ ID NO: 906 |
| 14055 | AA | SYDMH SEQ ID NO: 58 | VISYEGTNEYYAESVKG SEQ ID NO: 905 | ERYFDWSFDY SEQ ID NO: 60 |
| 14033 | AA | SYDMD SEQ ID NO: 70 | VIWYEGSNKYYAESVRG SEQ ID NO: 907 | ETGEGWYFDL SEQ ID NO: 72 |
| 14034 | AA | SYDMD SEQ ID NO: 70 | VIWYEGSNKYYAESVRG SEQ ID NO: 907 | ETGEGYYFDL SEQ ID NO: 908 |
| 14051 | AA | SYSWS SEQ ID NO: 82 | YIYYSGSTNYNPSLKS SEQ ID NO: 83 | NYAFHFDY SEQ ID NO: 909 |
| 14046 14048 | AA | SYYWS SEQ ID NO: 94 | YIYYIGSTNYNPSLKS SEQ ID NO: 95 | ESRYRSGWYDAFDI SEQ ID NO: 910 |
| 14047 | AA | SYYWS SEQ ID NO: 94 | YIYYIGSTNYNPSLKS SEQ ID NO: 95 | ESRYRSGYYDAFDI SEQ ID NO: 911 |
| 14042 | AA | GYYWS SEQ ID NO: 100 | YIYYIGSTNYNPSLKS SEQ ID NO: 101 | EGSSGWYRWFDP SEQ ID NO: 912 |

TABLE IV-continued

| Ab | Type | CDR 1 | CDR 2 | CDR 3 |
|---|---|---|---|---|
| 14043 | AA | GYYWS<br>SEQ ID NO: 100 | YIYYIGSTNYNPSLKS<br>SEQ ID NO: 101 | DGSSGYYRYFDP<br>SEQ ID NO: 913 |
| 14069 | AA | SYAMN<br>SEQ ID NO: 118 | TISGGGANTYYAESVKG<br>SEQ ID NO: 914 | GGMGGYYYGMDV<br>SEQ ID NO: 120 |
| 14062<br>14063<br>14064 | AA | SYFIH<br>SEQ ID NO: 124 | IINPISVSTSYAQKFQG<br>SEQ ID NO: 125 | GGIQLYLHFDY<br>SEQ ID NO: 915 |
| 14100<br>14101 | AA | SYFIH<br>SEQ ID NO: 130 | IINPISVSTSYAQKFQG<br>SEQ ID NO: 131 | GGIQLYLHLDY<br>SEQ ID NO: 916 |
| 14097 | AA | SYYIH<br>SEQ ID NO: 136 | IINPSGGSTRYAQKFQG<br>SEQ ID NO: 137 | GGIQLYLHFDY<br>SEQ ID NO: 917 |
| 14091<br>14092 | AA | NYYMS<br>SEQ ID NO: 142 | IINPSGGDSTYAQKFQG<br>SEQ ID NO: 143 | GGIQLYLHFDY<br>SEQ ID NO: 918 |
| 14087 | AA | SYYMS<br>SEQ ID NO: 148 | IIHPSGGDTTYAQKFQG<br>SEQ ID NO: 149 | GGIKLYLHFDY<br>SEQ ID NO: 919 |
| 14082 | AA | GYYWS<br>SEQ ID NO: 154 | YIYYIGSTNYNPSLKS<br>SEQ ID NO: 155 | EGSSGYYRYFDP<br>SEQ ID NO: 920 |
| 14079 | AA | RYGIH<br>SEQ ID NO: 160 | VIWYEGSNKYYAESVKG<br>SEQ ID NO: 921 | RAGIPGTTGYYYGMDV<br>SEQ ID NO: 162 |
| 14073<br>14076 | AA<br>AA | SYFIH<br>SEQ ID NO: 1<br>SYGMH<br>SEQ ID NO: 4 | IINPISVSTSYAQKFQG<br>SEQ ID NO: 2<br>VIWYDGSNKYYADSVKG<br>SEQ ID NO: 5 | GGIQLYLHLDY<br>SEQ ID NO: 3<br>RAGIIGTTGYYYGMDV<br>SEQ ID NO: 6 | b: LIGHT CHAIN CDRs

| 14039<br>14302<br>14303 | AA | SGDRLGEKYTS<br>SEQ ID NO: 922 | QDTKRPS<br>SEQ ID NO: 197 | QAWESSTVV<br>SEQ ID NO: 923 |
|---|---|---|---|---|
| 14301 | AA | SGDRLGEKYTC<br>SEQ ID NO: 196 | QDTKRPS<br>SEQ ID NO: 197 | QAWESSTVV<br>SEQ ID NO: 923 |
| 14022<br>14024<br>14025<br>14026<br>14027<br>14028 | AA | RASRQISSSYLA<br>SEQ ID NO: 924 | GPSSRAT<br>SEQ ID NO: 215 | QQYGSSFT<br>SEQ ID NO: 216 |
| 14029 | AA | RASQSISSSYLA<br>SEQ ID NO: 925 | GPSSRAT<br>SEQ ID NO: 215 | QQYGSSFT<br>SEQ ID NO: 216 |
| 14058<br>14059 | AA | TGSSSNIGTGYAVH<br>SEQ ID NO: 220 | GNNNRPS<br>SEQ ID NO: 221 | QSYESRLSGWV<br>SEQ ID NO: 926 |
| 14050<br>14051 | AA | TGSSSNIGTGYDVH<br>SEQ ID NO: 250 | GNSNRPS<br>SEQ ID NO: 251 | QSYESSLSGWV<br>SEQ ID NO: 927 |
| 14063 | AA | SGSSSNIGSNFVN<br>SEQ ID NO: 292 | TNNQRPS<br>SEQ ID NO: 293 | ATWDESLQGWV<br>SEQ ID NO: 928 |
| 14064 | AA | SGSSSNIGSNFVN<br>SEQ ID NO: 292 | TNNQRPS<br>SEQ ID NO: 293 | ATYDDSLNGWV<br>SEQ ID NO: 929 |
| 14099 | AA | SGSSSNIGSNFVN<br>SEQ ID NO: 298 | TNNQRPS<br>SEQ ID NO: 299 | ATWDESMQGWV<br>SEQ ID NO: 930 |
| 14100 | AA | SGSSSNIGSNFVN<br>SEQ ID NO: 298 | TNNQRPS<br>SEQ ID NO: 299 | ATYDESMQGWV<br>SEQ ID NO: 931 |

TABLE IV-continued

| Ab | Type | CDR 1 | CDR 2 | CDR 3 |
|---|---|---|---|---|
| 14101 | AA | SGSSSNIGSNFVN<br>SEQ ID NO: 298 | TNNQRPS<br>SEQ ID NO: 299 | ATYDDSMNGWV<br>SEQ ID NO: 932 |
| 14096 | AA | SGSSSNIGRNFVN<br>SEQ ID NO: 304 | TNNQRPS<br>SEQ ID NO: 305 | AAWDESLNGWV<br>SEQ ID NO: 933 |
| 14097 | AA | SGSSSNIGRNFVN<br>SEQ ID NO: 304 | TNNQRPS<br>SEQ ID NO: 305 | AAWDESLQGWV<br>SEQ ID NO: 934 |
| 14090<br>14091 | AA | SGSRSNIGSNFVN<br>SEQ ID NO: 310 | TNYQRPS<br>SEQ ID NO: 311 | AVWDESLNGWV<br>SEQ ID NO: 935 |
| 14092 | AA | SGSRSNIGSNFVN<br>SEQ ID NO: 310 | TNYQRPS<br>SEQ ID NO: 311 | AVYDESLQGWV<br>SEQ ID NO: 936 |
| 14085 | AA | SGSRSNIGSNFVN<br>SEQ ID NO: 316 | TNNQRPS<br>SEQ ID NO: 317 | AVYDDSLNGWV<br>SEQ ID NO: 937 |
| 14086<br>14087 | AA | SGSRSNIGSNFVN<br>SEQ ID NO: 316 | TNNQRPS<br>SEQ ID NO: 317 | AVYDESLQGWV<br>SEQ ID NO: 938 |
| 14077<br>14078 | AA | SGDRLGEKYVS<br>SEQ ID NO: 939 | QDNKWPS<br>SEQ ID NO: 329 | QAWDSSTVV<br>SEQ ID NO: 330 |
| 14304 | | | | |
| 14079 | AA | SGDRLGEKYVS<br>SEQ ID NO: 939 | QDNKWPS<br>SEQ ID NO: 329 | QAWESSTVV<br>SEQ ID NO: 940 |
| 14080 | AA | SGDRLGEKYVY<br>SEQ ID NO: 941 | QDNKWPS<br>SEQ ID NO: 329 | QAWDSSTVV<br>SEQ ID NO: 330 |
| 14075 | AA | SGSRSNIGSNFVN<br>SEQ ID NO: 334 | TNNQRPS<br>SEQ ID NO: 335 | ATWDESMQGWV<br>SEQ ID NO: 942 |
| 14076 | AA | SGSRSNIGSNFVN<br>SEQ ID NO: 334 | TNNQRPS<br>SEQ ID NO: 335 | ATYDESMQGWV<br>SEQ ID NO: 943 |

Human and Cynomologous Monkey Cadherin-19
Sequences

TABLE V

| SEQ ID NO. | DESIGNATION | SOURCE | TYPE | SEQUENCE |
|---|---|---|---|---|
| 944 | Human Cadherin-19 | Human | aa | MNCYLLLRFMLGIPLLWPCLGATENSQTKKVKQPVRSHLRVKRGWVNQFFVPEEMNTTSHHIGQLRSDLDNGNNSFQYKLLGAGA GSTFIIDERTGDIYAIQKLDREERSLYILRAQVIDIATGRAVEPESEFVIKVSDINDNEPKFLDEPYEAIVPEMSPEGTLVIQVTA SDADDPSSGNNARLLYSLLQGQPYFSVEPTTGVIRISSKMDRELQDEYWVIQAKDMIGQPGALSGTTSVLIKLSDVNDNKPIFKE SLYRLTVSESAPTGTSIGTIMAYDNDIGENAEMDYSIEEDDSQTFDIITNHETQEGIVILKKVNFEHQNHYGIRAKVKNHHVPEQ LMKYHTEASTTFIKIQVEDVDEPPLFLLPYVFEVFEETPQGSFVGVVSATDPDNRKSPIRYSITRSKVFNINDNGTITTTNSLDR EISAWYNLSITATEKYNIEQISSIPLVVQVLNINDHAPEFSQYYETVVCENAGSGQVIQTISAVDRDESIEEHHFYFNLSMGFKTEVIIAIL SSFTIIDNQDNTAVILTNRTGFNLQEEPVFYISILIADNGIPSLTSTNTLTIHVCDGDSGSTQTCQYQELVLSMGFKTEVIIAIL ICMIIFGFIFLFLTGLGLKQRRKQLFPEKSEDFRENIFQYDDEGGEEDTEAFDIAELRSSTIMRERKTRKTTSAEIRSLYRQSLQV GPDSAIFRKFILEKLEEANTDPCAPPFDSLQTYAFEGTGSLAGSLSSLESAVSDQDESYDYLNELGPRFKRLACMFGSAVQSNN |
| 945 | Human Cadherin-19 | Human | nt | atgaactgttattactgctgcgtttatgttgggaattcctcctcctcatggcctgctcttggagcaacaagaaaactctcaaacaaa gaaagtcaagcaagccggcgatctcattgaagctgaagcctggccagtgctgggttgtaccaggagaaataata cgactagtcatcacatccggccagctaagatctgattagacaatgaacaatcttcccagtacaagcttgggactgagct ggaagtacttcttcattgatgaagaacaggtgacatatgcccattgggaaccggacaggtcatcaaagttcgatcaatgaca atgagccaggtgaatgaccagcagtccctatgaggcgtgtactcagagggatcgtcctcagtgtacttcaggctacacatt agtgatgctgacgatccctcaagtggtaatatgtccgtccttctctcaagcagatgtggtaatgacaatgagtattggtaac aacaaggagtcataagaatatctctaaaatggatagaacaagtgtaattaaacttcagatgtaatgacaatgccatgtgataa aggagacatga ttgcagccaggagcgttgtctggaacaacaagtgtattaaacttcagatgtaatgacaatggcatggcaatggctaatgaagaa agttataccggcttgactgttgactgttctgaattctgaacctggacttctatggaacaatgaacatttgacaactattactactggttatctactggttgaa gaatgcagaaatgctacagcaggtgactttgagcacctacagctattagcagcccactacgtattagagcaagcactcagcag ttatattaaaagaagtaaccaccaccactagcaacagcctgagcttccaccactctcattaagatccaggtggaggtcttactacagctgaagtgcttgatggagcagcagcgt ctctcacaggatatcaccagaagctttgaatgtgtgcaccagacaatcagaagctggt cctccaggtattcttattacaaccagctactgaagctacaataatgatagcaacagcaaccagtgtacaagtaactactggttaacctcaaggaactgt ctctacatctccatcttaattgccgacaatgaactccgtcacttaaggtaccaaaccccttaccatccatcgtctgtgactgtg cttgacaggtggagcaccagatcgcagtagcacaagctgtcttccaatggattcagaagaaacaagatctctattcctgagaaag atttgcattatgacatttgggtttcattttttgactttgggttgaaacaaccggagaaaaacagattctattccgaagatctctattcctgagaaag tgaagatcagagaaagatatattccataatgatgattgaggaggatacagaagctagatagacatagacagagctga ggagtagtacaataatgggaacagccagactcggaaaacccaaagcctgaagaaagctcgaagagcctataagatcaaggtcttttgcaaagtt ggcccccgacagtgccatattccaggaaattcattctgaaaaagtctgaagaaagctaatactgatcggtgccctcctcttgattc cctccagaaccctacgctttgagggaacaggtgtgaacaggtgcattagctaggtcatgtttggttctgcagtgcagtcaaattag |
| 946 | Cyno Cadherin-19 | Macaca fascicularis | aa | MNCYLLLPFMLGIPLLWPCLGATENSQTKKVVQQPVGSHLRVKRGWVNQFFVPEEMNTTSHVGRLRSDLDNGNNSFQYKLLGAGA GSTFIIDERTGDIYAIEKLDREERSLYILRAQVIDITTGRAVEPESEFVIKVSDINDNEPKFLDEPYEAIVPEMSPEGTLVIQVTA SDADDPSSGNNARLLYSLLQGQPYFSVEPTTGVIRISSKMDRELGQPGALSGTTSVLIKLSDVDNKPIFKE SLYRLTVSESAPTGTSIGTIMAYDNDIGENAEMDYSIEDDSQTFDIITNHETQEGIVILKKKVNFEHQNHYGIRAKVKNHHVDEQ LMKYHTEASTTFIKIQVEDVDEPPLFLLPYYIFEIFEETPQGSFVGVVSATDPDNRKSPIRYSITRSKVFNIDDNGTITTTNSLDR EISAWYNLSITATEKYNIEQISSIPVVQVLNINDHAPEFSQYYESVVCENAGSGQVIQTISAVDRDESIEEHHFYFNLSVEDTNS SSFTIIDNQDNTAVILTNRTGFNLQEEPIFYISILIADNGIPSLTSTNTLTIHVCDCDDSGSTQTCQYQELMLSMGFKTEVIIAIL ICMVIFGFIFLTGLGLKQRRKQLFPEKSEDFRENIFRYDDEGGEEDTEAFDVAALRSSTIMRERKTRKTTSAEIRSLYRQSLQV GPDSAIFRKFILEKLEEADTDPCAPPFDSLQTYAFEGTGSLAGSLSSLESAVSDQDESYDYLNELGPRFKRLACMFGSAVQSNN |

TABLE V-continued

| SEQ ID NO. | DESIGNATION | SOURCE | TYPE | SEQUENCE |
|---|---|---|---|---|
| 947 | Cyno Cadherin-19 | Macaca fascicularis | nt | ATGAATTGTATTACTGCTGCTTTTATGTTGGGAATTCCTCTCCATGGCCTTGTCTTGAGCAACAGAAAACTCTCAAACAAA GAAAGTCCAGCAGCCAGTAGGATCTCATCTGAGAGTGAAGCGTGGCTGGGTGTGGAACCAATTTTTGTACCAGAGGAAATGAATA CGACTAGTCATCACGTTGGCCGCTAAGATCTGATTTAGACAATGGAAACAATTCTTTCCAGTACAAGCTTTTGGAGCTGGAGCT GGAAGTACTTTTATCATTGATGAAGACATTGACATATATGCCATAGAAGCTGATAGAGAGGAGCACTCTTTCATCAATATCACTCTT AAGAGCCCAGGTAATAGACATCACTACTGGAAGGCCTGTGGAACCTGAGTCGAGTTTGTCATCAAAGTTTCGGATATCAATGACA ATGAACCAAAATTCCTAGATAGACCCTTGATGAGGCTTATGATGCTCCAGAGGAACATTAGTCATCATCCAGTGACAGCA AGTGATGCTGATGACCTATAAGAATATCTCCAAGTGGTAATAATGCTGGTAAAAAAAACTTTACAAGGCCAGCCATATTTCTGTTGAACC AACAACAGGAGTCATAGAATATCTTCGAACAACGAGTGTATTAATTAAACTTCAGATGTTAATGACAATAAGCCTATATTAAAGA TTGGTCAGCCAGGAGCGTTGTCTGGAGAACAAGTGTATTATTAATTAAACTTCAGATGTTAATGACAATAAGCCTATATTAAAGA AGTTTATACCGCCTGACGGTCTCGACATTGCACCCACTGGAGATTGGAGATTGAGGATTATCATGGCATATGAATGATAATGGAAACTCAAGAAGGAATAG GAATGCGAAATGGATTACAGCATTGAAGAGATGAATTTGAGCAACAACCATGTGGTATTAGGACAACATCCTGATGGTGAGGCAG TTATATTAAAAAAGAAAGTGAATTTGAGCAACAACCACTATGGTATTAGGACAACATCCTTAAAAACCATCGTGATGAGCAG CTCATGAAATACCACACTGAAGCTTCCACCACTTTTCATTAAGATCCAGGTGGAAGATGTTGATGAGCCTCCTTTTCCTCC GTATTACATATTTGAAATTTTGAAGAAAACCCACAAGGATCATTTGTAGGGCTGGTGTCTGCCACAGACCCAGACAATAGGAAAT CTCCTATCGGTATTCTATTAGGACAAGTGTTCAATATCGATGATAATGGTACAATCACTACACTAACTCACTGGATCGG GAAATCAGTGCTGGTACAACCTAAGTATTACAGCCACAGAAAAATACAATATAGAGAGATCTTCAGTCCAGTGTATGTGCA AGTTCTTAATATCAATGATCATCTCCTGAGTTCTCTCAATACTATGAGAGTTATGTTTGTGAAAATCCAGGCCCTTGGAA TTCAGATCAGTGCAGTGGATAGAGATCAAGATAACAGCTGTCATTTTACTAATAGAACTGGTTTAACCTTCAAGAAGCCCAT TCTCTACATCTCCATCTTAATTGCCGACAATGAAATCCCGTCCACTTACAAGTACAAACACCCTTACCATCCATGTCTGTGACTGTG ATGACAGTGGAGCACAGACAGACCTGCCAGTACACAGAGACCTTTGGGTTCTTTCCATGGATTCAAGACAGAAGTCATCATGCTATTCTC ATTTGCATTATGTAATATTGGGTTATTATTTTGACTTGGGTTTAAAACAACCGAGAAGAATACAGGCCTTTGACGGCAAGCCTGA TGAAGATTTCAGAGAGAATATATTCGATATGATGACGAAGGGGTGAGAGATGAAGATACAGAGGCCTTTGACGTAGCAGCCTGA GGAGTAGCACCTAATGCGAAACAACTACCAGCCTGAAGAATCCAGGGGTGAAGAAAGTCGAAGAAGTGAATCAGGCGTCTTGCAAGTTT GGCCCCGACAGTGCCATATTCAAGGAAGTTCATCTGAATTGCTGGATCCCTGAGCTCTCAAGATCAGCTGTCGGCCTCCTTTGATTC CCTCCAGACCTACCGCTTTGAGGGAACAAGGCGATCATTAGTGTTAGACCCTTTAAAGATTACAGCATGCATGTTTGGGAAAACGCTATCAGCTGTCGTGCCCCCCTTTTGATTC GCTATGATTACCTTAACGAGTTGGGACCTCGCTTTTAAAAGATTAGCATGCATGCATGTTTTGTTCTGCAGTGCAGTCAAATAATTAG |
| 948 | secreted Cadherin-19 ecto-domain (amino acids 1-596) | Human | aa | MNCYLLLRFMLGIPLLWPCLGATENSQTKKVKQPVRSHLRVKRGWWNQFFVPEEMNTTSHHIGQLRSDLDNGNNSFQYKLLGAGA GSTFIIDERTGDIYAIQKLDREERSLYILRAQVIDIATGRAVEPESERFVIKVSDINDNEPKFLDEPYEAIVPEMSPEGTLVIQVTA SDADDPSSGNNARLLYSLLQGQYFSVEPTTGVIRISSKMDRELQDEYWVIIQAKDMIGQPGALSGTTSVLIKLSDVNDNKPIFKE SLYRLTVSESAPTGTSIGTIMAYDNDIGENAEMDYSIEEDDSQTFDIITNHETQEGIVILKKKVDFEHQNHYGIRAKVKNHHVPEQ LMXYHTEASTTFIKIQVEDVDEPPLFLLPYYVFEVFEETPQGSFVGVVSATDPDNRKSPIRYSITRSKVFNINDNGTITTSNSLDR EISAWYNLSITATEKYNIEQISSIPLIVQVLNINDHAPEFSQYYETYVCENAGSGQVIQTISAVDRDESIEEHHFYFNLSVEDTNN SSFTIIDNQDNTAVILTNRTGFNLQEEPVFYISILIADNGIPSLTSNTLTHIVHCDCGDSGSTQTCQYQELVLSMGFKTE |
| 949 | secreted Cadherin-19 ecto-domain (amino acids 1-596) | Human | nt | atgaactgttattactgctgcttttatgttgggaattcctctccatggccttgtcttgagcaacagaaaactctcaaacaaa gaaagtccagcagccagtgcatctcattgaagctgaagcgtggctggtgtgaacccaattttttgtaccagaggaaatgaata cgactagtcatcacatcggccagctaagatctgattagacaatggaaacaattctttccagtacaagctttttggagctggagct ggaagtacttttatcattgatgaacagttgacatatatgccatagaaagctgatagagagaggaggcactctttcatcaatatcaca aagagcccaggtaatagacactactggaaggcctgtgaacctgagtcgagtttgtcatcaaagttttcggatatcaatgacaa atgaaccaaaatcctagatagaccttgatgaggcttatgatgctccagaggaacattagtcatcatccagtgacagca agtgatgctgatgacctataagaatatctcccaagtgtaataatgctcgtcttccagtggactactccagccatcatttcttgttgaacc aacaacaggagtcatagaatatcttcgaacacgagtgtattaattaaacttcagatgttaatgacaataagccagctatttaaagaa aggtcagccaggagcgtgtctggagaacaagtgtattaattaaacttcagatgttaatgacaataagccagctatttaaagaa agttataccgcctgacgtctctgacattgcacccactggagattggagattacatggcatatgaatgatactaggaga gaatgcagaaatggattacagcattgaagagatgattgcgaaacattcaaaacacgtattagaaccactatagtcctgagcag ttatattaaaagaaagtggatttgaagaaactaggagctgcacactccataagatccaggtggaagatgttgatgagcctccttttcctcc ctcatgaagtaccacactgaagcttccaccactctcaattaagacccagagtcattgaggcgtgttgtctgccacagaccagacaataggaaat atattattgtatttgaagtttgaagaaccccacagggatcattgaggcgtgttgtctgccacagaccagacaataggaaat |

TABLE V-continued

| SEQ ID NO. | DESIGNATION | SOURCE | TYPE | SEQUENCE |
|---|---|---|---|---|
| | | | | ctcctatcaggtattcttattactaggacaaagtgtcaatatcaatgataatgtactactactcaagtaactcactggatcgt gaaatcagtgcttggtacaacctaagtattacagccaagtattacagaacacaatacaatagaacatcttcgatccactgtatgtca agtcttaacatcaatgatcatgtcctgagttcctcaatctatatgagacttattgttgtgaaaatgcaggctcctgtcaggtaa tcagactatcagtgcagtgcagtggatagagatgaatcaacaacagttcgacccattttacttactactctactcgtgaagacactaacaat tcaagtttacacactgaatatcaagaacacagtgctcttttaacctagagttcaagagaactgt cttcacatccatcttaattgcgacaactgccagtgccgacaatgaatccgtcactcactaacaagtacaacccaccatccatgtctgactgt gtgacagtgggacacacaagaccaaccagacggtctgctccatgtgacttccatggaggattcaagacaga |
| 950 | truncated membrane bound form of human cadherin-19 (amino acids 1-624) | Human | aa | MNCYLLRFMLGIPLLWPCLGATENSQTKKVKQPVRSHLRVRGWVWNQFFVPEEMNTTSHHIGQLRSDLDNGNNSFQYKLLGAGA GSTFIIDERTGDIYAIQKLDREERSLYILRAQVIDIATGRAVEPESEFVIKVSDINDNEPKFLDEPYEAIVPEMSPEGTLVIQVTA SDADDPSSGNNARLLYSLLQGQPYFSVEPTTGVIRISSKMDRELQDEYWVIQAKDMIGQPGALSGTTSVLIKLSDVNDNKPIFKE SLYRLITVSESAPIGTSIGTIMAYDNDIGENAEMDYSIEEDDSQTFDIIITNNHETQEGIVILKKKVDFEHQNHYGIRAKVKNHVPEQ LMXYHTEASTTFKIQVDDEPPLFLPLFYVPEVFEETPQGSFVGVVSATDPDNRKSPIRYSITRSKVFNINDNGTITTSNSLDR EISAWYNLSITATEKYNIEQISSIPLYVQVLNINDHAPEFSQYYETYVCENAGSGQVIQTISAVDRDESIEBHHFYFNLSVEDTNN SSFTIIDNQDNTAVILTNRTGFNLQEEPVFYISILIADNGIPSLTSTNTLTIHVCDCGDSGSTQTCYQELVLSMGFKTEVIAIL ICIMIIFGFIFLTLGLKQRRKQ |
| 951 | truncated membrane bound form of human cadherin-19 (amino acids 1-624) | Human1 | nt | atgaactgttattactgctgctgtcttatgtgggaattcctcctcatgcctgtcttcttggcaacagaaaactctcaaacaa gaaagtcaagcagccagtgcgatctcattgagagtgaagctgctgtgggaaccaattttgtaccagagaaatgaata cgactagtcatcacatcggcccagtcaagctgattagacaatggaacaatcctccagtacaagctttggagctggagct ggaagtacttttattgatgaaagaaccggtgacatatgccataacatcacacgagagttaatagaagcgatcctctacatctt aagagcccaggtaatagacatcctagtgaaccctatgaggctgtgaaccctgagtctgagttgtcatcaaagttcggatatcaatgaca atgaaccaaaattcctagatgaacctcaagtggtaatatgctgctcctcacagttaccagaggaacattagtatcaggtgacagca agtgatcgacaagaagaatcctcctcaaatgatgataaagtctaatcattctgtgaacc aacaacagagtcaatagaatcttctaaaatgataaaatcttcaagatggttggtaatcattcaagccaagacatga ttggtcagcaggaggtgctcagaacatgatgttaattaaactctcagatgtaatgaagctgtattaaagaa agtttacccgctctgctgcatctccgaatctgcacccactgggactctcctctagagaacaatcatgaaactcaagaaggaatag gaatgcagaaatggatacagcattgaagagggatgatctgagcaccaacgtatagagcaaactacgttacaagctgtcctgagcag ctcgaagtaccaacaccaggaggattcgaagaactcatcaggtgaagatcaggtggaagatggaagcctcctctcctccc atattatgtatttgaagttttcatctaggagcaagttatcagcacagaagcaaagtgtcatcaatgatgtcacgagacatggaaat ctcctatcagtgctttggtgaacacaaccaagttctactacagccaaggtagttcaataatatacagagaacactactcctgatcatatgtgca agtcctaacatccatcttaattaacgcgacaactgccagtgccgacaatgaatccgtcactctcactaacaagtacaacccaccatccatgtctgactgt cttccatccatccatcttaattgcgacaactgccagtgccgacaatgaatccgtcactctcactaacaagtacaacccaccatccatgtctgactgt gtgacagtgggacacacaagaccaaccagacggtctgctccatgtgacttccatggaggattcaagacagacagatcatgtctgtctgctcatgcttattctc atttgcattatgatcatatttggtttattttgactttggttaaaacaacaccgagaaaacag |
| 952 | C137897 huCDH19 (44-141) muCDH19 (140-770) | artificial | aa | GWVWNQFFVPEEMNTTSHHIGQLRSDLDNGNNSFQYKLLGAGAGSTFIIDERTGDIYAIQKLDREERSLYILRAQVIDIATGRAVE PESEFVIKVSDINDNEPRFLDEPYEAIVPEMSPEGTFVIKVTANDADDPSTGYHARLLYNLERGQPYFSVEPTTGVIRISSKMDRE LQDTYCVIIQAKDMLGQPGALSGTTTVSIKLSDINDNKPIFKESFYRPTISESAPIGTSIGKIMAYDDIGENAEMEYSIEDDSK IPDIIIDNDTQEGIVILKKVDFEQQSYYGIRAKVKNCHVDEELAPAHVNASTTYIKVQVEDEDEPPVFLLPYYILEIPEGKPYGT IVGTVSATDPDRRQSPMRYYLTGSKMFDINDNGTIITTNMLDREVSAWYNLTVTATETYNVQQISSAHVYQVFNINDNAPEFSQF YETYVCENAESGEIVQIISAIDRDESIEDHHFYFNHSLEDTNNSSFMLTDNQDNTAVILSNRTGFNLKEEPVFYMILIADNGIPS LTSTNTLTIQVCDCGDSNTETCANKGLLFIMGFRTEAIIAIMICVMVIFGFFLLIIALKQRRKETLFPEKTEDFRENIFCYDDEG GEEEDSRAFDIVELRQSTVMRERKPQRSKSAEIRSLYRQSLQVGPDSAIFRKFILEKLEEANTDPCAPPFDSLQTFAYEGTGSSAG SLSSLASRDTDQEDDFDYLNDLGPRFKRLASMFGSAVQPNN |

TABLE V-continued

| SEQ ID NO. | DESIGNATION | SOURCE | TYPE | SEQUENCE |
|---|---|---|---|---|
| 953 | C137897 huCDH19 (44-141) muCDH19 (140-770) | artificial | nt | ggctgggtgtgaaccaattttttgtaccaggaggaaatgaatacgactagtcatcacatcggccagctaagatctgattagacaa tggaaacaattctttccagtacagaagctttggagctggagctggaagtgactttatcatgatgaagaacaggtgacatatg cctacagaagcttgatagagaggaggcatccctcactcttaaagcgctaatagacatcgctactgaaggctgtggaa cctgagtctgagttgtcatcaagttcggatcatgacaagttcctagatgaacaattcctagagcctatgaggccattgtacc tagatgtctccagaaggaacattgtcatcaagtgacagccaatgacgcagtatcctcaactggtctatcatgtcgcatcc tatacactaggaacgaggtcaaccatactttctcgttgagccaacatgctcggcagctgagccttgtctgaacaacaccgtactcaat tagcgtgcagataatactatgcaacaatgcaattccaagagaaagtttctaccgcttcaatctgcaccattgaa catcaataatgacatatggcatatgatgatgacaccaagaaggagatagtactactaaagaaagtttgatttttgacagagcatta atatttgacatagcagcttaaggtaaaaaactcggtcctgttctcctgtacaagtctcaagtgctttaacgcttccacaactcacatttaaag ttcaagtgaagatgaagatgaaactcctctgttgaaatgctgataaactcgtgaaatgtcagtgagtccatagaaca attgtgggacggttctgccagacccagatcgaagacatacatatattatatcctctgaagaagcaaaatgtttgatat caatgcaataggaacaatcactcttcagcctttacgtgcttaatatttctacaaagctttatgtagcgagggtttgtgacagagtcatcaagtccttaacgtagcaatcctctcaagtgtccagaga ttcaggtcagaagatcagccacagctgttttgcagacgacggctcagagacagaaactgtgctaacacagagcc ctttatcagtgaattcacacattcttaatcactctctgagaaagactgtagtctgactctgtgagagtatctgaagaact ctctgagacacgaagagaccaagggtcccagcagcgtgagctgaaggttttagtaggggaatatattttctatgatgaggc gggggaagcggagactcggagcctgtgaaccagtgcccagactagaaagtacagttgcatatacttactttctctacaaggaagc gagccggagatcaggagcttgtgcagacgctcccgagaacccagagccgatgagaccagtgaaactcagaacagaagaactgcatttcgaaaattatctagaagc ttgaagaagccaacacgacccatgtgctgctccccctgattcactacagacgtgacagcggttgagcggtcatcagtgc tcctgagctcctgcctccagagacctgagacaggagacttcgactgcctcaataagctgggactccgttttaaagatt agcaagcatgttctgccagtacaacccaacactag |
| 954 | C137896 huCDH19 (44-249) muCDH19 (248-770) | artificial | aa | GWVNQFFVPEEMNTTSHHIGQLRSDLDNGNNSFQYKLLGAGAGSTFIIDERTGDIYAIQKLDREERSLYILRAQVIDIATGRAVE PESEFVIKVSDINDNEPKFLDEFYEAIVPEMSPEGTLVIQVTASDADDPSSGNNARLLYSLLQGQPYFSVEPTGVIRISSKMDRE LQDEYWVIIQAKDMIGQPGALSGTTSVLIKLSDVNDNKPIFKESFYRFTISESAPIGTSIGKIMAYDDIGENAEMEYSIEDDDSK IPDIIIDNDTQEGIVILKKKVDFEQQSYYGIRAKVKNCHVDEELAPAHVNASTTYIKVQVEDEDEPPVFLLPYYILEIPEGKPYGT IVGTVSATDPDRRQSPMRYYLTGSKMPDINDNGTIITTNMLDREVSAWYNLIVTATETYNVQQISSAHVYVQVFNINDNAPFSQF YETYVCENAESGEIVQIISAIDRDESIEDHHFYNHSLEDTNNSSFMLTDNQDNTAVLSNRTGFNLKEEPVFYMILIADNGIPS LITSNTLITIQVCDCGDSRNTETCANKGLLFIMGFRTEAIIAIMICVMVIFGFFFLILALKQRRKETLFPEKTEDFRENIFCYDDEG GGEEDSRAFDIVELRQSTVMRERKPQRSKSAEIRSLYRQSLQVGPDSAIFRKFILEKLEEANTDPCAPPFDSLQTFAYEGTGSSAG SLSSLASRDTDQEDDFDYLNDLGPRFKRLASMFGSAVQPNN |
| 955 | C137896 huCDH19 (44-249) muCDH19 (248-770) | artificial | nt | ggctgggtgtgaaccaattttttgtaccaggaggaaatgaatacgactagtcatcacatcggccagctaagatctgattagacaa tggaaacaattctttccagtacagaagctttggagctggagctggaagtgactttatcatgatgaagaacaggtgacatatg cctagtctgagttgtcatcaagttcggatcatgacaagttcctagatgaacaattcctagagcctatgaggccattgtacc agagatgtctccagaaggaacattagtatcaagtgacagccaatgacgcagtatcctcaagtggtaataatgctctgcctcc tctacagcttacttccagggaacattggtaatcatccaggcaagtgtgccaggaagccatgattgtcagccaggagttgtctggaacaacaagtgtattaat taaactttcagatgtaatgacaacaagccaatattccaaggagagttatgaaaaatttctaccgcttcactattctgaatctgcaccattgaa catcaataggaaaattggcatatatgatgacaccaagaaggagatagtactactaaaggaagtttgatttttgacagagcatta atatttgacatagcagcttaaggtaaaaaactcggtcctgttctcctgtacaagtctcaagtgctttaacgcttccacaactcacattaaag tggcattagaaataggagatgaactccctgttcctcttacccatatacattacttggaaatcctgaggaaaaccatatgaaca ttcaagtgggacggttctgccagacccagatcgaagacaatcctccagagctgaatattatctcctactgaaggcaaaatgtttgatat |

| SEQ ID NO. | DESIGNATION | SOURCE | TYPE | SEQUENCE |
|---|---|---|---|---|
| | | | | caatgacaatggacaataatcaccactaacatgcttgacagagaggcagtgcttgtacaacttgactgtcacagctactgaaa |
| | | | | catacaatgtacaacagatcttcagccatgttatgtacaagctttaacattaacgacaatgccagatgtctctcaattc |
| | | | | tatgagacttatgttgtgaaaatgcaattcagatcatcagtgcaattgaagatgagtcagtcagtcctcagaaga |
| | | | | tcaccattttacttaatcactcctcgaagacacaaacaactcaagtttatgctaacagatcaagataacacagctgtaa |
| | | | | tctgagtaataacactgtttcaatctactactcaagagagagcctgcttccaagtaacagagatgctgcagataacagctgcccatct |
| | | | | ctcacagcacaaacactctcactatccaagtctgtgactgtggacagtagaaacacagaaacttgtctaacagaaggactct |
| | | | | ctttatcatggattcagaacagaggacactcattttgacatgctagaagactgaagacttaggagaagacttaggacttcagtgtgtcatgatgatgaaggc |
| | | | | gcgggaaggaaaggagactcgaagctttgacattgctagagctggaacagaagtaatgacagaaaagcctcagagaagcaa |
| | | | | gagtgcggagatcaggagcttgcacagcagtgctcccccctttgattcactcacagtggccagagcagttgcctatgaggaacaggtcatcagctggc |
| | | | | ttgaagagccaacacagaccactgtgtctcccccccctttgattcactcacagtggccagagcagttcgactacctaatgacctggacctcgtttaaaagatt |
| | | | | agcagctgttggctctgcagtacaaccaaccaattag |
| 956 | C137913 muCDH19 (44-139) huCDH19 (142-249) muCDH19 (248-770) | artificial | aa | AWWRPFVVLEEMDDIQCVGKLRSDLLDNGNNSFQYKLLGIGAGSFSINERTGEICAIQKLDREEKSLYILRAQVIDTTIGKAVETE SFFVIRVLDINDNEPKFLDEPYEAIVPEMSPEGTLVIQVTASDADDPSSGNNARLLYSLLQQOPYFSVEPTTGVIRLSSKMDRELQ DEYWVIIQAKDMGQPGALSGTTSVLIKLSDVNDNKPIFKESFYRFTISESAPIGTSIGKIMAYDDIGENAEMEYSIEDDSKIF DIIIDNDTQEGIVILKKKVDFEQQSYYGIRAKVKNCHVDEELAPAHVNASTYYIKVQVEDEDPPVFLLPYYILEIPEGKPYGTIV GTVSATDPDRRQSPMRYLTGSKMFDINDNGTIITTNMLDREVSAWNLTVTATETYNVQQISSAHVYVQVFNINDNAPEFSQFYE TVVCENAESGEIVQIISAIDRDESIEDHHFYFNHSLEDTNNSFMLTDNQDNTAVILSNRTGFNLKEPVFYMIILIADNGIPSLT STNTLTIQVCDCGDSRNTETCANKGLLFIMGFRTEAIIAIMICVMVIFGFFFLILALKQRRKETLFPEKTEDFRENIFCYDDEGGG EEDSEAFDIVELRQSTVMRERKPQRSKSAEIRSLYRQSLQVGPDSAIFRKFILEKLEEANTDPCAPPPDSLQTFAYEGTGSSAGSL SSLASRDTDQEDFDYLNDLGPRFKRLASMFGSAVQPNN |
| 957 | C137913 muCDH19 (44-139) huCDH19 (142-249) muCDH19 (248-770) | artificial | nt | gctcggtgtggagaccatttgtgttctagaagaaatgatgatcaacatgttggaagctaagactgtgaactagagacaatgg aacaaacctttccagtacaagctactgggatggctggagctggaagcttagcttagcattgaagaacaggtgaaatatgtgccatac agaagcttgatagagaggaaaatccctcaattcgatgagagcccaggtaatgacaccattggaaggctgtggaaactgaa tccgagttgtcatcagagttttggatatcaatgacaatgaacccaaaaatccagatgaacctatgaaccttatgaggccattgtaaccagagat gctccaaggaacattagtatccaggatatgatgtcgacgaagtgaccgtcaggggtgacagtcaggcccaggtgtaataatgtcgtcctcctaca gctacttcaaggcagccagccatattttctgttgaacaacaagctcatcagaagtcatcaagatatctcctaaaatgatagaaactgcaa gatgagtattggtaatcaagccaataaagaaagtttctaccgcttcactatctgaatctgcaccatggaacaacaagtgtattaataaact ttcagatgttaatgacaacagccatatgatgacatgggagaatcagatggagaatcagagtgcagtgagatttgatgtacagcattgaagatgattgcaaccatcatttt gacatacattgaacagaacaccagacaacaagaagtgatagtactttccaacaagaaaggtttgagcagcagcagctatatgcat tagagctaagttaaaactgccatgtgataagaggaaaatccctgttctttctcctaccattacacttgaaatcctgaaggaaacattatggaaggtgtgaaactgaa tagaagatgaagatgaaccctctgcagttggattactacaaggattaaccatcccacactcctacgaagttcctcacctactgggatataatgtta gggaacggttctgccacagaccagtcgatcagaccttctgtcatacaccaggaaccaatctctatgagatattatctcactgaagacaaaaatgttgatatcaatga caatgaacaataatcaccaacatgcttcacagaagaccatgatgtcagagaagaggtcacagctgtcacagtcaaggactcacagagaaactgcaa gatgagtattggtaatgacaacaagccaatattcaaagaaagttctacgggtctgaacaacaagtgttattaataaact tcagatgttaatgacaacaagccaataatgcaaagaaagttctacgcttaccgcttcactatctgaatctgcaccatggaacaacaagtgtattaataaact acctatgttgaaatgtgtaatgacaacaagcttatcagacgaagaagtggtgagatagtcaacaacatcaagtgttcagatctttaacatgacaagtcagtgcaacatgatgataagaagaaagataccaccacca tttactaaactgttcaatctcacctcctccctcaagtgtaatcatcatcaagtggtgagagacagtgagacagatgtgagacaccaccaccagtgctgactgaaattctga gtaataactgtcttcaaccaagtcgtgatgtgagaccagtgtgatgtgagacagtgtgataagcttgctaatcagagaagagctgattcgcagagggcaagttgccc agcaacaccttcacctcctcaagtcgatcatcaactatatttatgttatggagaatatattgctcatgatgaaggcggcggg catggattcagaacagaggagcttcattcttccccaaggaagactcattgtacagggcccagagcagtgaagaagatggtgaaacaagagaag aacaaacagactcgtacaggagcttgacaagcttgcaagttgtaccagcattgaaagttgctacatatttcgataagagaggaagcttgaag aagcacaagaacaaatggaagtgaactgccgcagtctcttcaatcactcagcagctgtatagatatccagcattatggtgaagaacaagagtgactcactcttccactaca ggaaatcaggagttacaggagaccaaggcttgacaggcagtgcctgaccaggtggcccagtgacaggtatgcccagacagtttgctactacagagcttgccttatgccataatcagcgtttgcctatgagggaacaggtcatcagctgctgactgaaggaaagagtgagagagttgactacctaatgacctggacctcgtttaaaagattagcaag catgttggctctgcagtacaacccaaccaattag |

TABLE V-continued

| SEQ ID NO. | DESIGNATION | SOURCE | TYPE | SEQUENCE |
|---|---|---|---|---|
| 958 | C137847 muCDH19 (44-139) huCDH19 (142-364) muCDH19 (363-770) | artificial | aa | AWVRPFVVLEEMDDIQCVGKLRSDLDNGNNSFQYKLLGIGAGSFSINERTGEICAIQKLDREEKSLYILRAQVIDTTIGKAVETE SEFVIRVLDINDNEPKFLDEPYEAIVPEMSPEGTLVIQVTASDADDPSSGNNARLLYSLLQQPYFSVEPTTGVIRISSKMDRELQ DEYWVIIQAKDMLGQPGALSGTTSVLIKLSDVNDNKPIFKESLYRLTVSESAPTGTSIGTIMAYDNDIGENAEMDYSIEEDSQTF DIITNHETQEGIVILKKKVDFEHQNHYGIRAKVKNHHVPEQLMKYHTEASTTPFIKIQVEDVDEPPVFLLPYYILEIPEGKPYGTIV GTVSATDPDRRQSPMRYLTGSKMFDINDNGTIITTNMLDREVSAWYNLTVTATETYNVQQISSAHVYVQVFNINDNAPEFSQFYE TVYCENAESGEIVQIISAIDRDESIEDHHFYFNHSLEDTNNSSFMLTDNQDNTAVILSNRTGFNLKEPVFYMIILIADNGIPSLT STNTLTIQVCDCGDSRNTETCANKGLLFIMGFRTEAIIAIMICVMVIFGFFPLILALKQRRKETLFPEKTEDFRENIFCYDDEGGG EEDSEAFDIVELRQSTVMRERKPQRSKSAEIRSLYRQSLQVGPDSAIFRKFIIEKLEEANTDPCAPPFDSLQTFAYEGTGSSAGSL SSLASRDTDQEDDFDYLNDLGPRFKRLASMFGSAVQPNN |
| 959 | C137847 muCDH19 (44-139) huCDH19 (142-364) muCDH19 (363-770) | artificial | nt | gctggtgtggagaccattgtgttctagaagaaatgatgatacaatgtgttggaaagctaagatctgacttagacatgg aacaactcttccagtacaagctaagccttgggatttggcctggactgggaagctaatgaaaagaacagtgaaatgaaactgaa agagcctatagagagagaaaatcatgttctgcagcctcatgaaatcctgaagaaagctttcctccacacttcattaagatccagg tccgagttgtcatcagagtttggatatcaatgacaatgaacacaaaaatctccagatgaacttatgaggccattgtaccagagat gtctcccagaaggaacattagtatccaggtgcagcaggttgtatatctcaaagtgcagaatatctctaaaatggataqaactgcaa gcttacttcaaggccagccatattttctgttgaaccaacaagcatgaggatcatagaacaacaagtgtatttaattaaact gatgattggtaatcatcaagccaagtagtgctgtcaggagccttgtctgcaggagggctgctgagatctctgcccactctgaacacta cagtcctggcaaccaaggacactgtcgtcgtcaggacaccaccctatatgtgatccccgtagatgtcctggacaccaacaaagca atgtggcatgaccacaccgttccatcatcacgcagagctacgtaaagtggtataatgtggataaggagacaacatcttcaaggcag agacaaaacactctcactcctactcagccgatgctcagccatgtttatgtatacagagtttctaacttaagtacatgctgaaaatgcttcagcctcgaagcagacgtaacaaccttcactcctattccagagaagctctattttgaagatgaaagctcctgaagccgggcaagttgaagaactcagagagcttgtacaggagctccctgcaggtgggcccaatgtgtatcattctgaaaattttatcctgaagaagcttgaag aagccaacagagcaagagatctgaagctgttccagttcttattcactcacagttatgtttgcctatcagggcatcagcctgctctgt agtcctggcatccagagaacactgatcaggagactgactcactatctgaccctggcctgttaaagattagcaag catgttggctctgcagtacgatcctcaacactag |
| 960 | C137911 muCDH19 (44-247) huCDH19 (250-364) muCDH19 (363-770) | artificial | aa | AWVRPFVVLEEMDDIQCVGKLRSDLDNGNNSFQYKLLGIGAGSFSINERTGEICAIQKLDREEKSLYILRAQVIDTTIGKAVETE SEFVIRVLDINDNEPRFLDEPYEAIVPEMSPEGTFVIKVTANDADDPSTGYHARILYNLERGQPYFSVEPTTGVIRISSKMDRELQ DTYCVIIQAKDMLGQPGALSGTTTVSIKLSDINDNKPIFKESLYRLTVSESAPTGTSIGTIMAYDNDIGENAEMDYSIEEDSQTF DIITNHETQEGIVILKKKVDFEHQNHYGIRAKVKNHHVPEQLMKYHTEASTTPFIKIQVEDVDEPPVFLLPYYILEIPEGKPYGTIV GTVSATDPDRRQSPMRYLTGSKMFDINDNGTIITTNMLDREVSAWYNLTVTATETYNVQQISSAHVYVQVFNINDNAPEFSQFYE TVYCENAESGEIVQIISAIDRDESIEDHHFYFNHSLEDTNNSSFMLTDNQDNTAVILSNRTGFNLKEPVFYMIILIADNGIPSLT STNTLTIQVCDCGDSRNTETCANKGLLFIMGFRTEAIIAIMICVMVIFGFFPLILALKQRRKETLFPEKTEDFRENIFCYDDEGGG EEDSEAFDIVELRQSTVMRERKPQRSKSAEIRSLYRQSLQVGPDSAIFRKFIIEKLEEANTDPCAPPFDSLQTFAYEGTGSSAGSL SSLASRDTDQEDDFDYLNDLGPRFKRLASMFGSAVQPNN |
| 961 | C137911 muCDH19 (44-247) huCDH19 | artificial | nt | gctggtgtggagaccattgtgttctagaagaaatgatgatacaatgtgttggaaagctaagatctgacttagacatgg aacaactcttccagtacaagctaactgggattggcctggactgggaagctaatgaaaagaacagtgaaactgaa agaagcttgatagagagagaaaatcctctacattctgagagccaggtaatgacaccactattggaaggctgtgaaactgaa tccgagttgtcatcagagtttggatatcaatgacaatgaaccaagttcccagatccaggataaccatatgaggccattgaccatgagat |

TABLE V-continued

| SEQ ID NO. | DESIGNATION | SOURCE | TYPE | SEQUENCE |
|---|---|---|---|---|
| | (250-364) muCDH19 (363-770) | | | gtctccagaaggaacatttgtcatcaaggtgacagcagcaatgacgcagatgatccttcaactgctatcatgtctgcatcctatca acttagaacgaggtcaaccatattctgttttctgttgagccaacaacagagtcattaaggatcattcttaaggatgataggagttgcaa gatacatactgttgtaattattcaagccaaggaacatgtcggtcagcctggagcctgtctgaacacaaccgtatcaatcaagct gtcagatattaatgacataagcctatattcaagaaagttatacccttgactgctctgaattcgcaccactggacttcta taggaacaatcatgcacagtatagaaggattaccaatgaagaggatgattcgcaaacattt gacattattaactaatcatgaaactcaagaaggaatagttatattaaaaagaagtggatttgagcaccagaaccactacggtat tagagcaaaagtgttgatgaacctcctgtttcctcttacatactcggacttccaaccatgatgaacaattgtg gggaggttctccacgagccacgatgaattcctcctgagtatattctccctgacaaatttgtgatatcaatga caatggaacaataatcaccactacagctgcagaagggtcagtgctggtcacacttaaggtcacagctactgaaacataca atgtacaacagatctctcagccatgttatgtgaatctggtagagtcagatcatcagtgcaatgtcagaagatgagtccataagaagatcacca ttttacttaatcctctggaagacacacaacaagttctatgtaacagacaaccacgtgtaattctga gtaatgaactgttcaatcttaaagaagctgtctcttcacatcctgatgtgcttgataacggatcccatctccaca agcaacacacactcctatccaagttgtgactggtgagacagtaatattgctgactagaaaactgtgcaacaaggactctctttat catgggattcagaacaggacaattgccaatattggtatgtatggttttttcttttgattcttgtctga aacaggaagaagagactctttccaggagatttatgctacaatgaagaaggggcggg gaagaagactcggagccttgacaggagctgaccagctccacaggtgggcccagagagacatatattcgaacaagctgggtgaagcaagttgaa ggagatcaggagctgtacaggagccctgagccagtggctcactacagactgattgttctatcagagtgggcatgatgctcagagaagaagcttgaag aagccaccaagacccctgcatctgccctttgatcactaacgacagctttgctacatgaacaggcatcagtcatcagttggcctctg agtctcttggcctcgcagtacaaccaacaattag |
| 962 | C137917 muCDH19 (44-362) huCDH19 (365-772) | artificial | aa | AMWRPFVVLEEMDDIQCVGKLRSDLDNGNNSFQYKLLGIGAGSFSINERTGEICAIQKLDREEKSLYILRAQVIDTTIGKAVETE SFFVIRVLDINDNEPRFLDEPYEAIVPEMSPEGTFVIKVTANDADDPSTGYHARILYNLERGQPYFSVEPTTGVIRISSKMDRELQ DYTCVIIQAKDMLGQPGALSGTTTVSIKLSDINDNKPIFKESFYRFTISESAPIGTSGKIMAYDDDIGENAEMEYSIEDDSKIF DIIIDNDTQEGIVILKKKVDFEQQSYYGIRAKVKNCHVDEELAPAHVNASTYIKVQVEDEDEPPLFLLPYVFEVFEETPQGSFV GVVSATDPDNRKSPIRYSITRSKVFNINDNGTITTSNSLDREISAWYNLSITATEKYNIEQISSIPLYVQVLNINDHAPEFSQYYE TVVCENAGSGQVIQTISAVDRDESIEBHHFYFNLSVEDTNNSFTIIDNQDNTAVILTNRTGFNLQPEPVFYISILIADNGIPSLT STNTLTIHVCDCCDGSGSTQTCQYELVLSMGFKTEVIIAILICIMIPFGFIFLTLGLKQRRKQIFPIFLTGLGKQRRKQIFPEKSEDFRENIFQYDDEGG EEDTEAFDIAELRSSTIMRERKTRKTTSAEIRSLYRQSLVQGPDSAIFRKFILEKLREANTDPCAPPPDSLQTYAFEGTGSLAGSL SSLESAVSDQDESYDYLNELGPFKRLACMFGSAVQSNN |
| 963 | C137917 muCDH19 (44-362) huCDH19 (365-772) | artificial | nt | gctggtgtggagaccatttgtgttctagaagaaatggatgatatacaatgtgtggaagctaagatctgactagacaatgg aacaactcttccagtacaaggtactgggattgcctgaagctttagcattaatgacaccattggaaggctgtgaaactgcaa agaagctgataggagagaaataaccctctacattctgagcctaccaggtaatagacaccatctccagcatatatcaagaa tccgagtttgtcatcaggtttggatcagaagaaaatggcagtcaagactccagatcaatgaaccagatgaaccatgaggccatcatgtacctgagat gtctccagaaggaacatttgtcatcaaggtgacagcagcaatgacgcagatgatccttcaactgctatcatgtctgcatcctacta acttagaacgaggtcaaccatattctgttttctgttgagccaacaacagagtcattaaggatcattcttaaggatgataggagttgcaa gatacatactgttgtaattattcaagccaaggaacatgtcggtcagcctggagcctgtctgaacacaaccgtatcaatcaagct gtcagatattaatgacataagcctatattcaagaaagttatacccttgactgctctgaattcgcaccactggacttcta taggaacaatcatgcacagtatagaaggattaccaatgaagaggatgattcgcaaacattt gacattattaactaatcatgaaactcaagaaggaatagttatattaaaaagaagtggatttgagcaccagaaccactacggtat tagagcaaaagtgttgatgaacctcctgtttcctcttacatactcggacttccaaccatgatgaacaattgtg gggaggttctccacgagccacgatgaattcctcctgagtatattctccctgacaaatttgtgatatcaatga caatggaacaataatcaccactacagctgcagaagggtcagtgctggtcacacttaaggtcacagctactgaaacataca atgtacaacagatctctcagccatgttatgtgaatctggtagagtcagatcatcagtgcaatgtcagaagatgagtccataagaagatcacca ttttacttaatcctctggaagacacacaacaagttctatgtaacagacaaccacgtgtaattctga gtaatgaactgttcaatcttaaagaagctgtctcttcacatcctgatgtgcttgataacggatcccatctccaca tagaagatgaagatgagcctctccttctccctactcatattctcctatcaggttctttgaagttttgaagacaaaggttatatcaagg gcgtggtgtctccagaccagatgtgttggaagtgaatatgattattctccaaacagccaaagttcatatcaatga tatggtacaatcaacaagtaactcactgatgctgaagctgcaatctcagatgctccctagttcctcaataagcatgag atatagaacagatctcttcgatccactgcatgtccaagtctcaccaatcaatgatcagtgcgatagagatgaatcaagagagccacca tctattgtgaaatgcaggctctggtcaggaacactaacaattcaagtttcactcatagaataacacagtgtcatttga ctaatagaactgttttaaacctcaagaggacaagacctgttctctcacctccatcttaatgcgcacaatgaactccgtccacttaca |

TABLE V-continued

| SEQ ID NO. | DESIGNATION | SOURCE | TYPE | SEQUENCE |
|---|---|---|---|---|
| 964 | C137915 muCDH19 (44-461) huCDH19 (464-772) | artificial | aa | agtacaaacaccctaccatccatgtctgactgtggtgacagtgggagcacagacctgccagtaccagagctgtgcttc catgggattcaagacagagctcatcattctcattgcattcctgagaaagtgaagattcagagagataattcaatatgatgaaaacctggatga aacaacggagaaaacagattctctattcctgagaagacttgaactgaagattcagagagatattcggaacgaagctcgaagactcgaacagcgc tgatcaggaggctatcagagctgccagttctgcagttcccgacagtgcccagactggcccgacactacgcttgaggaacaggtcattagcgaag aagctaatactgatccgtgccccctcttgttcctccagaatgaaagctatgatacctaatgagtgggacctgctttaaaagattagcatg catgttggtctgcagtgcagtcaaataatag |
| | | | | AWWRPFVVLEEMDDIQCVGKLRSDLDNGNNSFQYKLLGIGAGFSINERTGEICAIQKLDREEKSLYILRAQVIDTTIGKAVETE SEFVIRVLDINDNEPRFLDEPYEAIVPEMSPEGTFVIKVTANDADDPSTGYHARILYNLERGQPYFSVEPTTGVIRISSKMDRELQ DTYCVIIQAKDMLGQPGALSGTTTVSIKLSDINDNKPIFKESFYRFTISESAPIGTSIGKIMAYDDDIGENAEMEYSIEDDDSKIF DIIIDNDTQEGIVILKKVDFEQQSYYGIRAKVKNCHVDEELAPAHVNASTTYIKVQVEDEDPPVFLLPYYILEIPEGKPYGTIV GTVSATDPDRRQSPMRYYLTGSKMFDINDNGTIITTNMLDREVSAWYNLTVTATETYNVQQISSAHVVQVFNINDHAPEFSQYYE TVVCENAGSGQVIQTISAVDRDESIEEHHFYFNLSVEDTNNSSFTIIDNQDNTAVLLTNRTGFNLQEEPVFYISILLADNGIPSLT STNTLTIHVCDCGDSGSTQTCYQELVLSMGFKTEVIIAILICIMIIPGFIFIFLTLGLKQRRKQILFPEKSEDFRENIFQYDDEGGG EEDTEAFDIAELRSSTIMRERKTRKTTSAEIRSLYRQSLQVGPDSAIFRKFILEKLEEANTDPCAPPFDSLQTYAFEGTGSLAGSL SSLESAVSDQDESYDYLNELGPFKRLACMFGSAVQSNN |
| 965 | C137915 muCDH19 (44-461) huCDH19 (464-772) | artificial | nt | gctctgggtgtggagaccattgtgtctcagaagaaatgatgatatacaatgtgactagatctgacttagacaatgg aacaactcttccagtacaagctactgggattgcctgggaagcttttagcattgagaaacaggtgaaataatgtgccatac agaagcttgatagagagaaaatcccctcactctgagaccccagtaatgacagtcctagatgaaccatattgaggaagctgtgaaactgaa tccgagttgtcatcagagtttggatcatcaatgacaatccagattcctagaccagcagtgatgaacccagagacttcatgctcatgctgagat gtctccgaaggaaccatctttctcatcaaggtgcacgccaatgacgcagatgacctcaactgctatcatgctcgcatcctataca acttagaaacgaggtcaacatcttctgttgagccaacaacaagtcatagtgaagatatctcttaagatgcaacaaccgtatcattaagct gatacactgtgtcaattattcaagccaagacccaatattcaaagaaagttctcaccgcttcactatctgaatcgaacatgaactcaa tagggaaaatatggcacatgatgacacacacagaaggagtagtaacactagaagtaacagtgaccaatgagcgaattgatttctgcagcagagttgtgcgatac gacataatcattgacaactgccatgtgacaagtgaaggctggaagcctgtaagctccaagcgttcaagcttcaacgcttcccacaccttaaagttcaag gggagaggtcattctgaaactctaccttagaaagatgaaggtgactctggaaatctctcaatactagtcgagatatataccagctactaacactagaccactactacatactactag catggacaataatcaccactactacctcatgagagggtcagctgctggtacaactcagctcgatctgattctcctcaatactatgag atgcaagtcacagctctctggccatgttatgtcagctccctgagttcctgtctgtaattcaagctttaactctcagtctcagataactatatagtag acttatgttgtgtgaaaatgcagctctggtcagaaagacccaactcaagtcctctcgactgtatgactcatcagtgatgaatcatctgaagaaccacaga ttttactttactcatctgtgaagaccaaatccaagaaagaccctgtcttctcactctccactcctaatgccgacaagcccgtcacttaca ctacaacactccatccatgtgtcacaggacccatctgaaggcaacaaacctgaaccaagttggttcaatttcttggttca catgggattcaagagaagatcatcattctcagatagcaggaagattcagaggagctgtacatgcggaaagatcggaacgaagctcgaagactcgaag tgaagactacacagaaccagccttcagccacccccatcatatatagcaacgcaagtctgagttatcttaatcttcgaaaactcgaag agcctcctagaatactgatccgtgccccctcttgtcaggatgaaagctatgatacctaatgagtgggacctgctttaaaagattagcatg catgttggtctgcagtgcagtcaaataatag |
| 966 | C71144 muCDH19 (44-770) | artificial | aa | AWWRPFVVLEEMDDIQCVGKLRSDLDNGNNSFQYKLLGIGAGFSINERTGEICAIQKLDREEKSLYILRAQVIDTTIGKAVETE SEFVIRVLDINDNEPRFLDEPYEAIVPEMSPEGTFVIKVTANDADDPSTGYHARILYNLERGQPYFSVEPTTGVIRISSKMDRELQ DTYCVIIQAKDMLGQPGALSGTTTVSIKLSDINDNKPIFKESFYRFTISESAPIGTSIGKIMAYDDDIGENAEMEYSIEDDDSKIF DIIIDNDTQEGIVILKKVDFEQQSYYGIRAKVKNCHVDEELAPAHVNASTTYIKVQVEDEDPPVFLLPYYILEIPEGKPYGTIV GTVSATDPDRRQSPMRYYLTGSKMFDINDNGTIITTNMLDREVSAWYNLTVTATETYNVQQISSAHVVQVFNINDNAPEFSQYYE |

TABLE V-continued

| SEQ ID NO. | DESIGNATION | SOURCE | TYPE | SEQUENCE |
|---|---|---|---|---|
| 967 | C71144 ::muCDH19 (44-770) | artificial | nt | TVVCENABSGEIVQIISAIDRDESIEDHHFYFNHSLEDTNNSFMLTDNQDNTAVILSNRTGFNLKEPVFYMIILIADNGIPSLT STNTLTIQVCDCGDSRNTETCANKGLLFIMGFRTEAIIAIMICVMVIFGFFFLILALKQRRKETLPPEKTEDFRENIFCYDEGGG EEDSEAFDIVELRQSTVMRERKPQRSKSAEIRSLYRQSLQVGPDSAIFRKFILEKLEEANTDPCAPPFDSLQTFAYEGTGSSAGSL SSLASRDTDQEDDFDYLNDLGPRFKRLASMFGSAVQPNN gctgggtgtgagaccattgtgttctagaagaagatgatatacaatgtgttggaaagctaagatctgacttagacaatgg aacaactctttccagtacaagctactgggattggcgctggaagctgagagcccaatgtggctagcttattggaagctggaaactgaa agaagcttgataggaagaaaaatccctctacattctgaggacgcaagtgattccaagatgacaaccactattggaagctgaagatgcatac tccagttgtctcagagttcgtcgatcatcagatccagtccagtccatgacacagtgtaccagatgcctattgtacctgagat gctcccagaaggaacattgtcatcactttctgtgacgagcaatgacgatgatcccttccaactgctatcatgctcgcatccataca actagaacgaggtcaaccatatttatcaagccaaggaacatgtcggtctgcgacaaacacgtatccaaggtatccaaggatagagagttgcaa gatacatactctgtgaattaatgacctgtctgtaatgagtgatgacacccaagaggcctgtcggaacaacaacagcttctaccccattgaaacatcaa tagggaaaaattacttgacactatgatgaccccaagagtcatacatagagaggtagtgactggaatacagcatgaagatgattcaaaaatttt gacatatcaatgacactgacaccccaagagtgatgaagagctgtgcacctgtaacgctccaacctacaatttgagcagcagcatatggcat taagagctaaggtaaaaactgcatgtggatcgaatcgtgatagtcgaatttcctctcaccatcatcatcctcgaagtgaaaatctctgaaagatccaatcatgag tagaagatgaagatgaaccctcctgtttctctcttaccatatctacatcatgctcgaaatctccaggaaaacatgaacaactgtg gggacggttctcccagacccagtccgaagacaatcctgtctttccacacagtaatctctcactggaagcaaaaatgttgtatcaatga caatggaacatcaataagatctctcagccagtcctatgacacagtctcagttcttaacatacgacaatgctccagatcctcaattctgag actatcttgtgaaatgtgaactgtgatcctgtgagatgtcagatcagcaaaggttctgatccattcctaccacatcagatctctgag gggacggttctaattcctctgaagacaacaatcctgtctctcctcacagcaaatcaagatgctacaagataacacagctgaattctga gtaatagaactgttcacttcctatcccaagtctgtgactgtggagacagtgaaaacaacaacttgtcaacaagtgctgacaaggagacttcttttat catggatcagaacctcagaacagggcaatattgccatcatgtgttgccatcatggattagggtttctcttgataaatacggtactgggaaaagctcgga aacaggaagagctcgaaagactctatttccaggaagaagctaggaagatactacagtcgtaagcatacagttgatcaagtcaagtgctcctga gggatcaagagcttgtacaggcagtcccagttggccagacgatcagcgacactctgtagatcaatctccctaatgaggacagttcatcagctggctctg agccaacacagaccctcagagtgtcccccctttgattcactacagacgttcgactaccttaatgacctgggacctggtttaaaagattagcaag agtccctggctatctcagacgagaacgactgactacactttaaagacctgggacctggtttaaaagattagcaag catgttggctctgcagtacaaccccaacaattag |
| 968 | Flag Tag | artificial | aa | DYKDDDDK |
| 969 | Flag Tag | artificial | nt | gactacaaagacgatgacaag |
| 970 | ckCDH19 (1-43) ::FLAG::ckCDH19 (44-776) | artificial | aa | MNCSTFLSLVLALVLQLCSPTTQIFSAQKTDQSYTTIRRVKRDYKDDDDKGWVEPLFVTEETSTMPMYVGQLKSDLDKEDGSL QYILTGEGADSIFFINEHGKIVRQKLDREKKSFYILRAQVINRKTRHPIEPDSEFIIKVRDINDHEPQFLDGPYVATVPEMSPEG TSVTQVTATDGDDPSYGNNARLLYSLIQGQPYFSVEPKTGVIRMTSQMDRETKDQYLVVIQAKDMVGQAGAFSATATVTINLSDVN DNPPKFQQRLYYLNVSEEAPVGTTVGRLLAEDSDIGENAAMNYFIEEDSSDVFGIITDRETQEGIIILKKRVDYESKRKHSVRKA VNRYIDDRFLKEGPFEDITIVQLSVVDADEPPVFTLESYVMEIAEGVVSGSLVGTVSARDLDNDDSSVRYSIVQGLHIKRLFSINE HNGTIITTEPLDREKASWHNITVTATETRNPEKISEANVYIQVLDVNDHAPEFSKYETFVCENAVPGQLIQNISAVDKDDSAENH RFYFSLAQATNSSHFTVKDNQDNTAGIFTAGSGFSRKEQFYFLPIFLILDNGSPPLTSTNTLTVTVCDCDTEVNTLYCRYGAFLYS IGLSTEALVAVLACLLLLLVFFLAIIGIRQQRKKTLFSEKVEEFRENIVRYDDEGGEEDTEAFDISALRTRAVLRPTHKPRKKITT EIHSLYRQSLQVGPDSAIFRQFISEKLEEANTDPSVPPYDSLQTYAFEGTGSLAGSLSLSGSNTSDVDQNYEYLVGWGPPFKQLAG MTSQRSTRD |
| 971 | huCDH19 (1-43) ::FLAG::hu (44-141) ::ckCDH19 | artificial | aa | MNCYLLRFMLGIPLLWPCLGATENSQTKKVKQPVRSHLRVKRDYKDDDDKGWVWNQFFVPEMNTTSHHIGQLRSDLDNGNNSFQ YKLLGAGAGSTPFIIDERTGDIYAIQKLDREERSLYIILRAQVIDIATGRAVEPESEFVIKVSDINDHEPQFLDGPYVATVPEMSPEG TSVTQVTATDGDDPSYGNNARLLYSLIQGQPYFSVEPKTGVIRMTSQMDRETKDQYLVVIQAKDMVGQAGAFSATATVTINLSDVN DNPPKFQQRLYYLNVSEEAPVGTTVGRLLAEDSDIGENAAMNYFIEEDSSDVFGIITDRETQEGIIILKKRVDYESKRKHSVRKA |

TABLE V-continued

| SEQ ID NO. | DESIGNATION | SOURCE | TYPE | SEQUENCE |
|---|---|---|---|---|
| | (142-776) | | | VNRYIDDRFLKEGPFEDITIVQISVVDADEPPVFTLESYVMEIAEGVVSGSLLVGTVSARDLNDDSSVRYSIVQGLHLKRLFSINE HNGTIIITEPLDREKASWHNITVTATETRNPEKISEANVYIQVLDVNDHAPEFSKYYETFVCENAVPGQLIQNISAVDKDDSAENH RFYFSLAQATNSSHFTVKDNQDNTAGIFTAGSGFSRKEQFYYFPLPILILDNGSPPLTSNTLTVTVCDCDTEVNTLYCRYGAFLYS IGLSTEALVAVLACLLILLVFFLAIIGIRQQRKKTLFSEKVEEFRENIVRYDDEGGEEDTEAFDISALRTRAVLRTHKPRKKITT EIHSLYRQSLQVGPDSAIFRQFISEKLEEANTDPSVPPYDSLQTYAFEGTGSLAGSLSSLGSNTSDVDQNYEYLVGWGPPFKQLAG MTSQRSTRD |
| 972 | ckCDH19(1-43) ::FLAG::ckCDH19 (44-141) ::huCDH19 (142-249) ::ckCDH19 (250-776) | | | MNCSTFLSLVLAIVQLQLCSPTTQIFSAQKTDQSYTTIRRVKRDYKDDDDKGWVWEPLFVTEEETSTMPMYVGQLKSDLDKEDGSL QYILTGEGADSIFFINEHGKIYVRQKLDREKKSFYILRAQVINRKTRHPIEPDSEFIIKVRDINDNEPKFLDEPYEATVPEMSPEG TLVIQVTASDADDPSSGNNARLLYSLLQGQPYFSVEPTGVIRISSKMDRELQDEYNVIIQAKDMIGQPGALSGTTSVLIKLSDVN DNPPKFQQRLYINVSEEAPVGTTVGRLLAEDSDIGENAAMNYFIEEDSSDVFGIITDRETQEGIIILKKRVDYESKRKHSVRVKA VNRYIDDRFLKEGPFEDITIVQISVVDADEPPVFTLESYVMEIAEGVVSGSLLVGTVSARDLNDDSSVRYSIVQGLHLKRLFSINE HNGTIIITEPLDREKASWHNITVTATETRNPEKISEANVYIQVLDVNDHAPEFSKYYETFVCENAVPGQLIQNISAVDKDDSAENH RFYFSLAQATNSSHFTVKDNQDNTAGIFTAGSGFSRKEQFYYFPLPILILDNGSPPLTSNTLTVTVCDCDTEVNTLYCRYGAFLYS IGLSTEALVAVLACLLILLVFFLAIIGIRQQRKKTLFSEKVEEFRENIVRYDDEGGEEDTEAFDISALRTRAVLRTHKPRKKITT EIHSLYRQSLQVGPDSAIFRQFISEKLEEANTDPSVPPYDSLQTYAFEGTGSLAGSLSSLGSNTSDVDQNYEYLVGWGPPFKQLAG MTSQRSTRD |
| 973 | ckCDH19(1-43) ::FLAG::ckCDH19 (44-249) ::huCDH19 (250-364) ::ckCDH19 (365-776) | | | MNCSTFLSLVLAIVQLQLCSPTTQIFSAQKTDQSYTTIRRVKRDYKDDDDKGWVWEPLFVTEEETSTMPMYVGQLKSDLDKEDGSL QYILTGEGADSIFFINEHGKIYVRQKLDREKKSFYILRAQVINRKTRHPIEPDSEFIIKVRDINDHEPQFLDGPYVATVPEMSPEG TSVTQVTATDGDDPSYGNNARLLYSLLIQGQPYFSVEPKTGVIRMTSQMDRETKDQYLVVIQAKDMVGQAGAFSATATVTINLSDVN DNKPIFKESLYRLTVSESAPTGTSIGTIMAYDNDIGENAEMDYSIEEDSSQTFDIITNHETQEGIVILKKKVDFEHQNHYGIRAKV KNHHVPREQLMKYHTEASTTFIKIQVEDVDEPPVFTLESYVMEIAEGVVSGSLLVGTVSARDLNDDSSVRYSIVQGLHLKRLFSINE HNGTIIITEPLDREKASWHNITVTATETRNPEKISEANVYIQVLDVNDHAPEFSKYYETFVCENAVPGQLIQNISAVDKDDSAENH RFYFSLAQATNSSHFTVKDNQDNTAGIFTAGSGFSRKEQFYYFPLPILILDNGSPPLTSNTLTVTVCDCDTEVNTLYCRYGAFLYS IGLSTEALVAVLACLLILLVFFLAIIGIRQQRKKTLFSEKVEEFRENIVRYDDEGGEEDTEAFDISALRTRAVLRTHKPRKKITT EIHSLYRQSLQVGPDSAIFRQFISEKLEEANTDPSVPPYDSLQTYAFEGTGSLAGSLSSLGSNTSDVDQNYEYLVGWGPPFKQLAG MTSQRSTRD |
| 974 | ckCDH19(1-43) ::FLAG::ckCDH19 (44-364) ::huCDH19 (365-463) ::ckCDH19 (469-776) | | | MNCSTFLSLVLAIVQLQLCSPTTQIFSAQKTDQSYTTIRRVKRDYKDDDDKGWVWEPLFVTEEETSTMPMYVGQLKSDLDKEDGSL QYILTGEGADSIFFINEHGKIYVRQKLDREKKSFYILRAQVINRKTRHPIEPDSEFIIKVRDINDHEPQFLDGPYVATVPEMSPEG TSVTQVTATDGDDPSYGNNARLLYSLLIQGQPYFSVEPKTGVIRMTSQMDRETKDQYLVVIQAKDMVGQAGAFSATATVTINLSDVN DNPPKFQQRLYINVSEEAPVGTTVGRLLAEDSDIGENAAMNYFIEEDSSDVFGIITDRETQEGIIILKKRVDYESKRKHSVRVKA VNRYIDDRFLKEGPFEDITIVQISVVDADEPPLLPYVFEVFEETPQGSFGYVSATDPDNRKSPIRYSITRSKVFNINDNGTI TTSNSLDREISAWNLSITATEKYNIEQISSIPLYVQVLNINDHAPEFSKYYETFVCENAVPGQLIQNISAVDKDDSAENHRFYFS LAQATNSSHFTVKDNQDNTAGIFTAGSGFSRKEQFYYFPLPILILDNGSPPLTSNTLTVTVCDCDTEVNTLYCRYGAFLYSIGLST EAIVAVLACLLILLVFFLAIIGIRQQRKKTLFSEKVEEFRENIVRYDDEGGEEDTEAFDISALRTRAVLRTHKPRKKITTEIHSL YRQSLQVGPDSAIFRQFISEKLEEANTDPSVPPYDSLQTYAFEGTGSLAGSLSSLGSNTSDVDQNYEYLVGWGPPFKQLAGMYTSQ RSTRD |
| 975 | (1-43) ::FLAG::ckCDH19 (44-468) ::huCDH19 (464-772) | | | MNCSTFLSLVLAIVQLQLCSPTTQIFSAQKTDQSYTTIRRVKRDYKDDDDKGWVWEPLFVTEEETSTMPMYVGQLKSDLDKEDGSL QYILTGEGADSIFFINEHGKIYVRQKLDREKKSFYILRAQVINRKTRHPIEPDSEFIIKVRDINDHEPQFLDGPYVATVPEMSPEG TSVTQVTATDGDDPSYGNNARLLYSLLIQGQPYFSVEPKTGVIRMTSQMDRETKDQYLVVIQAKDMVGQAGAFSATATVTINLSDVN DNPPKFQQRLYINVSEEAPVGTTVGRLLAEDSDIGENAAMNYFIEEDSSDVFGIITDRETQEGIIILKKRVDYESKRKHSVRVKA VNRYIDDRFLKEGPFEDITIVQISVVDADEPPVFTLESYVMEIAEGVVSGSLLVGTVSARDLNDDSSVRYSIVQGLHLKRLFSINE HNGTIIITEPLDREKASWHNITVTATETRNPEKISEANVYIQVLDVNDHAPEFSQYYETFVCENAGSGQVIQTISAVDRDESIEEH HFYFNLSVEDTNNSSFTIIDNQDNTAVLTNRFTGFNLQEEPVFYISILIADNGIPSLTSTNTLTIHVCDCGDSGSTQTCYQELVL SMGFKTEVIIAILICIMIIFGFIFLTLGLKQRRKQILFPEKSEDFRENIFQYDDEGGEEDTEAFDIAELRSSTIMRERKTRKTTS AEIRSLYRQSLQVGPDSAIFRKFILEKLEEANTDPCAPPFDSLQTYAFEGTGSLAGSLSSLESAVSDQDESYDLNELGPRFKRLA CMFGSAVQSNN |

TABLE V-continued

| SEQ ID NO. | DESIGNATION | SOURCE | TYPE | SEQUENCE |
|---|---|---|---|---|
| 976 | rhCDH19 (1-43)::FLAG::rhCDH19 (44-772) | | | MNCYLLLPFMLGIPLLWPCLGATENSQTKKVQQPVGSHLRVKRDYKDDDKGWVWNQFFVPEMNTSHHVGRLRSDLDNGNNSFQ YKLLGAGAGSTFIIDERTGDIYAIEKLDREERSLYILRAQVIDTTGRAVEPESEFVIKVSDINDNEPKFLDEPYEAIVPEMSPEG TLVIQVTASDADDPSSGNNARLLYSLLQGQPYFSVEPTTGVIRISSKMDRELQDEYWVIIQAKDMIGQPGALSGTTSVLIKLSDVN DNKPIFKESLYRLTVSESAPTGTSIGTIMAYDNDIGENAEMDYSIEDDSQTFDIITNHETQEGIVILKKKVNFEHQNHYGIRAKV KNHHVDEQLMKYHTEASTFIKIQVEDVDEPPLFLLPYIFEIFEETPQGSFVGVVSATDPDNRKSPIRYSITRSKVFNIDDNGTI TTTNSLDREISAWYNLSITATEKYNIEQISSIPVYVQVLNINDHAPEFSQYYESYVCENAGSGQVIQTISAVDRDESIEEHHFYFN LSVEDTNSSFTIIDNQDNTAVLTNRTGFNLQEEPIFYISLLIADNGIPSLTSTNTLTIHVCDCDDSGSTQTCYQELMLSMGFK TEVIIAILICIMVIFGFIFLILGLKQRRKQILFPEKSEDFRENIFRYDDEGGEEDTEAFDVAALRSSTIMRERKTRKTTSAEIRS LYRQSLQVGPDSAIFRKFILEKLEEANTDPCAPPFDSLQTYAFEGTGSLAGSLSLESAVSDQDESYDYLNELGPRFKRLACMFGS AVQSNN |
| 977 | caCDH19 (1-42)::FLAG::caCDH19 (43-770) | | | QFFVPEEMNKTDYHIGQLRSDLDNGNNSFQYKLLGAGAGSIFVIDERTGDIYAIQKLDREERSLYTLRAQVIDSTTGRAVEPESEF VIRVSDINDNEPKFLDEPYEAIVPEMSPEGTLVIQVTATDADDPASGNNARLLYSLLQGQPYFSIEPTTGVIRISSKMDRELQDEY WVIIQAKDMIGLPGALSGTTSVLIKLSDVNDNKPIFKERLYRLTVSESAPTGTSIGRIMAYDNDIGENAEMDYSIEDDSQTFDIIT NNETQEGIVILKKKVDFEHQNHYLIRANVKNRHVAEHLMEYHVEASTTFVRVQVEDEDPPVFLLPYLFEILEESPHGSFVGMVS ATDPDQRKSPIRYSITRSKVFSIDDNGTIITTNPLDREISAWYNLSITATEKYNVQQISAVPVYVQVLNINDHAPEFSEYYDSYVC ENAGSGQVIQTISAVDRDESVEDHHFYFNLSVEDTKNSSFIIIDNEDNTAVILTNRTGFSLQEEPVFYISVLIADNGIPSLTSTNT LTIHICDCDDYGSTQTCRDKDLLLSMGFRTEVILAILISIMIIFGFIFLILGLKQRRKPTLFPEKGEDFRENIFRYDDEGGEEDT EAFDIVQLRSSTIMRERKTRKTAAAEIRSLYRQSLQVGPDSAIFRKFILEKLEEANTDPCAPPFDSLQTYAFEGTGSLAGSLSLG SAVSDQDENYDYLNELGPRFKRLACMFGSAMQSNN |
| 978 | rhCDH19 (1-43)::FLAG::rhCDH19 (44-141)::caCDH19 (141-770) | | | MNCYLLLPFMLGIPLLWPCLGATENSQTKKVQQPVGSHLRVKRDYKDDDKGWVWNQFFVPEMNTSHHVGRLRSDLDNGNNSFQ YKLLGAGAGSTFIIDERTGDIYAIEKLDREERSLYILRAQVIDTTGRAVEPESEFVIKVSDINDNEPKFLDEPYEAIVPEMSPEG TLVIQVTATDADDPASGNNARLLYSLLQGQPYFSIEPTTGVIRISSKMDRELQDEYWVIIQAKDMIGLPGALSGTTSVLIKLSDVN DNKPIFKERLYRLTVSESAPTGTSIGRIMAYDNDIGENAEMDYSIEDDSQTFDIITNNETQEGIVILKKKVDFEHQNHYLIRANVK NRHVAEHLMEYHVEASTTFVRVQVEDEDPPVFLLPYLFEILEESPHGSFVGMVSATDPDQRKSPIRYSITRSKVFSIDDNGTII TTNPLDREISAWYNLSITATEKYNVQQISAVPVYVQVLNINDHAPEFSEYYDSYVCENAGSGQVIQTISAVDRDESVEDHHFYFNL SVEDTKNSSFIIIDNEDNTAVILTNRTGFSLQEEPVFYISVLIADNGIPSLTSTNTLTIHICDCDDYGSTQTCRDKDLLLSMGFRT EVILAILISIMIIFGFIFLILGLKQRRKPTLFPEKGEDFRENIFRYDDEGGEEDTEAFDIVQLRSSTIMRERKTRKTAAAEIRSL YRQSLQVGPDSAIFRKFILEKLEEANTDPCAPPFDSLQTYAFEGTGSLAGSLSLGSAVSDQDENYDYLNELGPRFKRLACMFGSA MQSNN |
| 979 | rhCDH19 (1-43)::FLAG::rhCDH19 (44-65)::caCDH19 (65-770) | | | MNCYLLLPFMLGIPLLWPCLGATENSQTKKVQQPVGSHLRVKRDYKDDDKGWVWNQFFVPEMNTSHHVGRLRSDLDNGNNSFQ YKLLGAGAGSTFIIDERTGDIYAIQKLDREERSLYTLRAQVIDSTTGRAVEPESEFVIRVSDINDNEPKFLDEPYEAIVPEMSPEG TLVIQVTATDADDPASGNNARLLYSLLQGQPYFSIEPTTGVIRISSKMDRELQDEYWVIIQAKDMIGLPGALSGTTSVLIKLSDVN DNKPIFKERLYRLTVSESAPTGTSIGRIMAYDNDIGENAEMDYSIEDDSQTFDIITNNETQEGIVILKKKVDFEHQNHYLIRANVK NRHVAEHLMEYHVEASTTFVRVQVEDEDPPVFLLPYLFEILEESPHGSFVGMVSATDPDQRKSPIRYSITRSKVFSIDDNGTII TTNPLDREISAWYNLSITATEKYNVQQISAVPVYVQVLNINDHAPEFSEYYDSYVCENAGSGQVIQTISAVDRDESVEDHHFYFNL SVEDTKNSSFIIIDNEDNTAVILTNRTGFSLQEEPVFYISVLIADNGIPSLTSTNTLTIHICDCDDYGSTQTCRDKDLLLSMGFRT EVILAILISIMIIFGFIFLILGLKQRRKPTLFPEKGEDFRENIFRYDDEGGEEDTEAFDIVQLRSSTIMRERKTRKTAAAEIRSL YRQSLQVGPDSAIFRKFILEKLEEANTDPCAPPFDSLQTYAFEGTGSLAGSLSLGSAVSDQDENYDYLNELGPRFKRLACMFGSA MQSNN |

TABLE V-continued

| SEQ ID NO. | DESIGNATION | SOURCE | TYPE | SEQUENCE |
|---|---|---|---|---|
| 980 | caCDH19(1-43)::FLAG::caCDH19(44-87)::rhCDH19(89-114)::caCDH19(115-770) | | | MNYCFLLPLMLGIPLIWPCFTASESSKTEVKHQAGSHLRVKRDYKDDDDKGMWNQFFVPEEMNKTDYHIGQLRSDLDNGNNSFQYKLLGAGAGSTFIIDERTGDIYAIEKLDREERSLYILRAQVIDSTTGRAVEPESEFVIRVSDINDNEPKFLDEPYEAIVPEMSPEGTLVIQVTATDADDPASGNNARLLYSLLGQQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIPGFIFLILGLKQRRKPTLFPEKGEDFRENIPRYDDEGGGEDTEAPDIVQLRSSTIMRERKTRKTAAAEIRSLYRQSLQVGPDSAIFRKFILEKLEEANTDPCAPPPDSLQTYAFEGTGSLAGSLSLGSAVSDQDENYDYLNELGPRFKRLACMFGSAMQSNN |
| 981 | caCDH19(1-43)::FLAG::rhCDH19(44-120)::rhCDH19(122-137)::caCDH19(137-770) | | | MNYCFLLPLMLGIPLIWPCFTASESSKTEVKHQAGSHLRVKRDYKDDDDKGMWNQFFVPEEMNKTDYHIGQLRSDLDNGNNSFQYKLLGAGAGSIFVIDERTGDIYAIEKLDREERSLYTLRAQVIDITTGRAVEPESEFVIKVSDINDNEPKFLDEPYEAIVPEMSPEGTLVIQVTATDADDPASGNNARLLYSLLGQQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIPGFIFLILGLKQRRKPTLFPEKGEDFRENIPRYDDEGGGEDTEAPDIVQLRSSTIMRERKTRKTAAAEIRSLYRQSLQVGPDSAIFRKFILEKLEEANTDPCAPPPDSLQTYAFEGTGSLAGSLSLGSAVSDQDENYDYLNELGPRFKRLACMFGSAMQSNN |
| 982 | rhCDH19(1-43)::FLAG::rhCDH19(44-141)::raCDH19(140-247)::rhCDH19(250-772) | | | MNCYLLLPFMLGIPLLWPCLGATENSQTKKVQQPVGSHLRVKRDYKDDDDKGWVNQFFVPEMNTTSHHVGRLRSDLDNGNNSFQYKLLGAGAGSTFIIDERTGDIYAIEKLDREERSLYILRAQVIDITTGRAVEPESEFVIKVSDINDNEPRFLDEPYEAIVPEMSPEGTFVIKVTANDADDPTSGYHARILYNLEQGQPYFSVEPTTGVIRISSKMDRELQDTYCVIIQAKDMLGQPGALSGTTTISIKLSDINDNKPIFKESLYRLTVSESAPTGTSIGTIMAYDNDIGENAEMDYSIEDDSQTFDIITNHETQEGIVILKKKVNFEHQNHYGIRAKVKNHHVDEQLMKYHTEASTTFIKIQVEDVDEPPLFLLPYYIFEETPQGSFVGVVSATDPDNRKSPIRYSITRSKVFNIDDNGTITTTNSLDREISAWYNLSTATEKYNIEQISSIPYYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDEGGGEEDTEAFDVAALRSSTIMRERKTRKTTSAEIRSLYRQSLQVGPDSAIFRKFILEKLEEAADTDPCAPPFDSLQTYAFEGTGSLAGSLSSLESAVSDQDESYDYLNELGPRFKRLACMFGSAVQSNN |
| 983 | raCDH19(1-43)::FLAG::raCDH19(44-770) | | | MNHYFLKYWILMVPLIWPCLKVAETLKIEKAQRAVPSLGRAKRDYKDDDDKGNVWKQFFVPEEMDTIQHVGRLRSDLDNGNNSFQYKLLGTGDGSFSIDEKTGDIFAMQKLDREKQSLYILRAQVIDTTIGKAVEPESEFVIRVSDVNDNEPRFLDEPYEAIVPEMSPEGTFVIKVTANDADDPTSGYHARILRAQVIDTTGVIRISSKMDRELQDTYCVIIQAKDMLGQPGALSGTTTISLKLSDINDNKPIFKESFYRFTISESAPSGTTIGKIMAYDDDIGENAEMDYSIEDDESQIFDIVIDNETQEGIVILKKKVDFEHQNHYGIRVKVKNCHVDEELAPAHVNASTTYIKVQVEDEDPPTFLLPYYIFEIPEGKPYGTMVGSAVDPDRRQSPMRYSLIGSKMFDINGNGTIVTTNLLDREVSAWYNLSVTATETYNVQQISSAHVVQVLNINDHAPEFSQLYETYVCENAESGEIIQTISAIRDESIEDHHFYFNHSSFILTDNQDNTAVILSNRAGFSLKEETVFYMIILIADNGIPPLTSTNTLTIQVCDCGDSRSTETCTSKELLFIMGFKAEAIIAIVICVMVIFGFIFLILALKQRRKETLFPEKTEDFRENIFCYDDEGGGEEDSEAPDIIELRQSTVMRERKPRKSRSAEIRSLYRQSLQVGPDSAIFRKFILEKLEEANTDSSAPPFDSLQTFAYEGTGSSAGSLSLGSSVTDQEDDFDYLNDLGPCFKRLANMFGSAVQPDN |

TABLE V-continued

| SEQ ID NO. | DESIGNATION | SOURCE | TYPE | SEQUENCE |
|---|---|---|---|---|
| 984 | (1-43)::FLAG::muCDH19 (44-323)::raCDH19 (324-327)::muCDH19 (328-770) | | | MNYCFLKHWILMIPLLWPCLKVSETLKAEKARRTVPSTWRAKRDYKDDDDKAWWRPFVVLEEMDDIQCVGKLRSDLDNGNNSFQY KLLGIGAGSFSINERTGEICAIQKLDREEKSLYILRERGQPYFSVEPTTGVIRISSKMDRELQDTYCVIIQAKDMLGQPGALSGTTTVSIKLSDINDN KPIFKESFYRFTISESAPIGTSGKIMAYDDDIGENAEMEYSIEDDDSKIFDIIIDNDTQEGIVILKKKVDFEHQNHYGIRAKVKN CHVDEELAPAHVNASTTYIKVQVEDEDEPPVFLLPYYILEIPEGKPYGTIVGTVSATPDRRQSPMRYYLTGSKMFDINDNGTIIT TNMLDREVSAWYNLTVTATETYNVQQISSAHYVQVFNINDNAPEFSQFYETYVCENAESGEIVQIISAIDRDESIEDHHFYFNHS LEDTNNSSFMLTDNQDNTAVILSNRTGFNLKEEPVFYMIILIADNGIPSLTSTNTLTIQVCDGGDSRNTETCANKGLLFIMGFRTE AIIAIMICVMVIFGFFFLILALKQRRKETLFPEKTEDFRENIFCYDDEGGGEEDSEAFDIVELRQSTVMRERKPQRSKSAEIRSLY RQSLQVGPDSAIFRKFILEKLEEANTDPCAPPPDSLQTFAYEGTGSSAGSLSSLASRDTDQEDDFDYLNDLGPRFKRLASMFGSAV QPNN |
| 985 | muCDH19 (1-43)::FLAG::muCDH19 (44-770)::raCDH19 (290, 299, 308) | | | MNYCFLKHWILMIPLLWPCLKVSETLKAEKARRTVPSTWRAKRDYKDDDDKAWWRPFVVLEEMDDIQCVGKLRSDLDNGNNSFQY KLLGIGAGSFSINERTGEICAIQKLDREEKSLYILRERGQPYFSVEPTTGVIRISSKMDRELQDTYCVIIQAKDMLGQPGALSGTTTVSIKLSDINDN KPIFKESFYRFTISESAPIGTSGKIMAYDDDIGENAEMEYSIEDDDSKIFDIIIDNDTQEGIVILKKKVDFEQQSYYGIRAKVKN CHVDEELAPAHVNASTTYIKVQVEDEDEPPVFLLPYYILEIPEGKPYGTIVGTVSATPDRRQSPMRYYLTGSKMFDINDNGTIIT TNMLDREVSAWYNLTVTATETYNVQQISSAHYVQVFNINDNAPEFSQFYETYVCENAESGEIVQIISAIDRDESIEDHHFYFNHS LEDTNNSSFMLTDNQDNTAVILSNRTGFNLKEEPVFYMIILIADNGIPSLTSTNTLTIQVCDGGDSRNTETCANKGLLFIMGFRTE AIIAIMICVMVIFGFFFLILALKQRRKETLFPEKTEDFRENIFCYDDEGGGEEDSEAFDIVELRQSTVMRERKPQRSKSAEIRSLY RQSLQVGPDSAIFRKFILEKLEEANTDPCAPPPDSLQTFAYEGTGSSAGSLSSLASRDTDQEDDFDYLNDLGPRFKRLASMFGSAV QPNN |
| 986 | muCDH19 (1-43)::FLAG::muCDH19 (44-770)::huCDH19 (271) | | | MNYCFLKHWILMIPLLWPCLKVSETLKAEKARRTVPSTWRAKRDYKDDDDKAWWRPFVVLEEMDDIQCVGKLRSDLDNGNNSFQY KLLGIGAGSFSINERTGEICAIQKLDREEKSLYILRERGQPYFSVEPTTGVIRISSKMDRELQDTYCVIIQAKDMLGQPGALSGTTTVSIKLSDINDN KPIFKESFYRFTISESAPIGTSGKIMAYDDDIGENAEMEYSIEDDDSKIFDIIIDNDTQEGIVILKKKVDFEQQSYYGIRAKVKN CHVDEELAPAHVNASTTYIKVQVEDEDEPPVFLLPYYILEIPEGKPYGTIVGTVSATPDRRQSPMRYYLTGSKMFDINDNGTIIT TNMLDREVSAWYNLTVTATETYNVQQISSAHYVQVFNINDNAPEFSQFYETYVCENAESGEIVQIISAIDRDESIEDHHFYFNHS LEDTNNSSFMLTDNQDNTAVILSNRTGFNLKEEPVFYMIILIADNGIPSLTSTNTLTIQVCDGGDSRNTETCANKGLLFIMGFRTE AIIAIMICVMVIFGFFFLILALKQRRKETLFPEKTEDFRENIFCYDDEGGGEEDSEAFDIVELRQSTVMRERKPQRSKSAEIRSLY RQSLQVGPDSAIFRKFILEKLEEANTDPCAPPPDSLQTFAYEGTGSSAGSLSSLASRDTDQEDDFDYLNDLGPRFKRLASMFGSAV QPNN |

SEQUENCE LISTING (986 sequences)

SEQ ID NO: 1 - DNA, 15 bp, artificial
  1D10, 2C12 - CDR-H1
agctatggcatgcac

SEQ ID NO: 2 - DNA, 51 bp, artificial
  1D10, 2C12 - CDR-H2
gttatatggtatgatggaagtaataaatactatgcagactccgtgaagggc

SEQ ID NO: 3 - DNA, 48 bp, artificial
  1D10, 2C12 - CDR-H3
agggccggtataataggaactacaggctactactacggtatggacgtc

SEQ ID NO: 4 - protein, 5 aa, artificial
  1D10, 2C12 - CDR-H1
SYGMH

SEQ ID NO: 5 - protein, 17 aa, artificial
  1D10, 2C12 - CDR-H2
VIWYDGSNKYYADSVKG

SEQ ID NO: 6 - protein, 16 aa, artificial
  1D10, 2C12 - CDR-H3
RAGIIGTTGYYYGMDV

SEQ ID NO: 7 - DNA, 21 bp, artificial
  1F10 - CDR-H1
agtggtggttactactggagc

SEQ ID NO: 8 - DNA, 48 bp, artificial
  1F10 - CDR-H2
tacatctattacagtgggagcacctactacaacccgtccctcacgagt

SEQ ID NO: 9 - DNA, 30 bp, artificial
  1F10 - CDR-H3
gatggaagcagtggctggtacttccagcac

SEQ ID NO: 10 - protein, 7 aa, artificial
  1F10 - CDR-H1
SGGYYWS

SEQ ID NO: 11 - protein, 16 aa, artificial
  1F10 - CDR-H2
YIYYSGSTYYNPSLTS

SEQ ID NO: 12 - protein, 10 aa, artificial
  1F10 - CDR-H3
DGSSGWYFQH

SEQ ID NO: 13 - DNA, 15 bp, artificial
  2C12_LC#1 - CDR-H1
agctatggcatgcac

SEQ ID NO: 14 - DNA, 51 bp, artificial; identical to SEQ ID NO: 2
  2C12_LC#1 - CDR-H2

SEQ ID NO: 15 - DNA, 48 bp, artificial; identical to SEQ ID NO: 3
  2C12_LC#1 - CDR-H3

SEQ ID NO: 16 - protein, 5 aa, artificial
  2C12_LC#1 - CDR-H1
SYGMH

SEQ ID NO: 17 - protein, 17 aa, artificial
  2C12_LC#1 - CDR-H2
VIWYDGSNKYYADSVKG

SEQ ID NO: 18 - protein, 16 aa, artificial
  2C12_LC#1 - CDR-H3
RAGIIGTTGYYYGMDV

SEQ ID NO: 19 - DNA, 15 bp, artificial
  2G6_LC#1 - CDR-H1
agctatggcatgcac

SEQ ID NO: 20 - DNA, 51 bp, artificial
  2G6_LC#1 - CDR-H2
tttatatggtatgatggaagtaataaatactatgcagactccgtgaaggac

SEQ ID NO: 21 - DNA, 48 bp, artificial
  2G6_LC#1 - CDR-H3
agggccggtataataggaactataggctactactacggtatggacgtc

SEQ ID NO: 22 - protein, 5 aa, artificial
  2G6_LC#1 - CDR-H1
SYGMH

SEQ ID NO: 23 - protein, 17 aa, artificial
  2G6_LC#1 - CDR-H2
FIWYDGSNKYYADSVKD

SEQ ID NO: 24 - protein, 16 aa, artificial
  2G6_LC#1 - CDR-H3
RAGIIGTIGYYYGMDV

SEQ ID NO: 25 - DNA, 15 bp, artificial
  2G6 - CDR-H1
agctatggcatgcac

SEQ ID NO: 26 - DNA, 51 bp, artificial; identical to SEQ ID NO: 20
  2G6 - CDR-H2

SEQ ID NO: 27 - DNA, 48 bp, artificial; identical to SEQ ID NO: 21
  2G6 - CDR-H3

SEQ ID NO: 28 - protein, 5 aa, artificial
  2G6 - CDR-H1
SYGMH

SEQ ID NO: 29 - protein, 17 aa, artificial
  2G6 - CDR-H2
FIWYDGSNKYYADSVKD

SEQ ID NO: 30 - protein, 16 aa, artificial
  2G6 - CDR-H3
RAGIIGTIGYYYGMDV

SEQ ID NO: 31 - DNA, 15 bp, artificial
  2H12 - CDR-H1
agctatggcatgcac

SEQ ID NO: 32 - DNA, 51 bp, artificial
  2H12 - CDR-H2
gttatatggtatgatggaagtaataaatactatacagactccgtgaagggc

SEQ ID NO: 33 - DNA, 48 bp, artificial; identical to SEQ ID NO: 3
  2H12 - CDR-H3

SEQ ID NO: 34 - protein, 5 aa, artificial
  2H12 - CDR-H1
SYGMH

SEQ ID NO: 35 - protein, 17 aa, artificial
  2H12 - CDR-H2
VIWYDGSNKYYTDSVKG

SEQ ID NO: 36 - protein, 16 aa, artificial
  2H12 - CDR-H3
RAGIIGTTGYYYGMDV

SEQ ID NO: 37 - DNA, 15 bp, artificial
  2H12_LC#2 - CDR-H1
agctatggcatgcac

SEQ ID NO: 38 - DNA, 51 bp, artificial; identical to SEQ ID NO: 32
  2H12_LC#2 - CDR-H2

SEQ ID NO: 39 - DNA, 48 bp, artificial; identical to SEQ ID NO: 3
  2H12_LC#2 - CDR-H3

SEQ ID NO: 40 - protein, 5 aa, artificial
  2H12_LC#2 - CDR-H1
SYGMH

SEQ ID NO: 41 - protein, 17 aa, artificial
  2H12_LC#2 - CDR-H2
VIWYDGSNKYYTDSVKG

SEQ ID NO: 42 - protein, 16 aa, artificial
  2H12_LC#2 - CDR-H3
RAGIIGTTGYYYGMDV

SEQ ID NO: 43 - DNA, 21 bp, artificial
  4A2, 5B4, 5C5   - CDR-H1
agtagtggttactactggagc

SEQ ID NO: 44 - DNA, 48 bp, artificial
  4A2, 5B4, 5C5  - CDR-H2
tacatctattacactgggagcgcctactacaacccgtccctcaagagt

SEQ ID NO: 45 - DNA, 30 bp, artificial
  4A2, 5B4, 5C5  - CDR-H3
gatggaagcagtggctggtacttccagtat

SEQ ID NO: 46 - protein, 7 aa, artificial
  4A2, 5B4, 5C5  - CDR-H1
SSGYYWS

SEQ ID NO: 47 - protein, 16 aa, artificial
  4A2, 5B4, 5C5  - CDR-H2
YIYYTGSAYYNPSLKS

SEQ ID NO: 48 - protein, 10 aa, artificial
  4A2, 5B4, 5C5  - CDR-H3
DGSSGWYFQY

SEQ ID NO: 49 - DNA, 15 bp, artificial
  4A9 - CDR-H1
ggttactactggagc

SEQ ID NO: 50 - DNA, 48 bp, artificial
  4A9 - CDR-H2
tatttctcttacagtgggagcaccaactacaacccctccctcaagagt

SEQ ID NO: 51 - DNA, 24 bp, artificial
  4A9 - CDR-H3
aactgggccttccactttgacttc

SEQ ID NO: 52 - protein, 5 aa, artificial
  4A9 - CDR-H1
GYYWS

SEQ ID NO: 53 - protein, 16 aa, artificial
  4A9 - CDR-H2
YFSYSGSTNYNPSLKS

SEQ ID NO: 54 - protein, 8 aa, artificial
  4A9 - CDR-H3
NWAFHFDF

SEQ ID NO: 55 - DNA, 15 bp, artificial
  4B10, 4C2 - CDR-H1
agctatgacatgcac

SEQ ID NO: 56 - DNA, 51 bp, artificial
  4B10, 4C2  - CDR-H2
gttatatcatatgatggaactaatgaatactatgcagactccgtgaagggc

SEQ ID NO: 57 - DNA, 30 bp, artificial
  4B10, 4C2 - CDR-H3
gaacgatattttgactggtcttttgactac

SEQ ID NO: 58 - protein, 5 aa, artificial
  4B10, 4C2 - CDR-H1
SYDMH

SEQ ID NO: 59 - protein, 17 aa, artificial
  4B10, 4C2 - CDR-H2
VISYDGTNEYYADSVKG

SEQ ID NO: 60 - protein, 10 aa, artificial
  4B10, 4C2 - CDR-H3
ERYFDWSFDY

SEQ ID NO: 61 - DNA, 15 bp, artificial
  4D2 - CDR-H1
agttatgacatgcac

SEQ ID NO: 62 - DNA, 51 bp, artificial; identical to SEQ ID NO: 56
  4D2 - CDR-H2

SEQ ID NO: 63 - DNA, 30 bp, artificial; identical to SEQ ID NO: 57
  4D2 - CDR-H3

SEQ ID NO: 64 - protein, 5 aa, artificial
  4D2 - CDR-H1
SYDMH

SEQ ID NO: 65 - protein, 17 aa, artificial
  4D2 - CDR-H2
VISYDGTNEYYADSVKG

SEQ ID NO: 66 - protein, 10 aa, artificial
  4D2 - CDR-H3
ERYFDWSFDY

SEQ ID NO: 67 - DNA, 15 bp, artificial
  4D3, 4F3 - CDR-H1
agctatgacatggac

SEQ ID NO: 68 - DNA, 51 bp, artificial
  4D3, 4F3 - CDR-H2
gttatatggtatgatggaagtaataaatactatgcagactccgtgaggggc

SEQ ID NO: 69 - DNA, 30 bp, artificial
  4D3, 4F3 - CDR-H3
gaaactggggagggctggtacttcgatctc

SEQ ID NO: 70 - protein, 5 aa, artificial
  4D3, 4F3 - CDR-H1
SYDMD

SEQ ID NO: 71 - protein, 17 aa, artificial
  4D3, 4F3 - CDR-H2
VIWYDGSNKYYADSVRG

SEQ ID NO: 72 - protein, 10 aa, artificial
  4D3, 4F3 - CDR-H3
ETGEGWYFDL

SEQ ID NO: 73 - DNA, 15 bp, artificial
  4E10 - CDR-H1
agctatgacatgcac

SEQ ID NO: 74 - DNA, 51 bp, artificial; identical to SEQ ID NO: 2
  4E10 - CDR-H2

SEQ ID NO: 75 - DNA, 30 bp, artificial
  4E10 - CDR-H3
gagtataggtacagctggtactttgactac

SEQ ID NO: 76 - protein, 5 aa, artificial
  4E10 - CDR-H1
SYDMH

SEQ ID NO: 77 - protein, 17 aa, artificial
  4E10 - CDR-H2
VIWYDGSNKYYADSVKG

SEQ ID NO: 78 - protein, 10 aa, artificial
  4E10 - CDR-H3
EYRYSWYFDY

SEQ ID NO: 79 - DNA, 15 bp, artificial
  4F7 - CDR-H1
agttactcctggagc

SEQ ID NO: 80 - DNA, 48 bp, artificial
  4F7 - CDR-H2
tatatctattacagtgggagcaccaactacaacccctccctcaagagt

SEQ ID NO: 81 - DNA, 24 bp, artificial
  4F7 - CDR-H3
aactgggccttccactttgactac

SEQ ID NO: 82 - protein, 5 aa, artificial
  4F7 - CDR-H1
SYSWS

SEQ ID NO: 83 - protein, 16 aa, artificial
  4F7 - CDR-H2
YIYYSGSTNYNPSLKS

SEQ ID NO: 84 - protein, 8 aa, artificial
  4F7 - CDR-H3
NWAFHFDY

SEQ ID NO: 85 - DNA, 15 bp, artificial
  5E3 - CDR-H1
agctatagcatgcac

SEQ ID NO: 86 - DNA, 51 bp, artificial
  5E3 - CDR-H2
tccattagtagtagtagtagttacatatactacgcagactcagtgaagggc

SEQ ID NO: 87 - DNA, 42 bp, artificial
  5E3 - CDR-H3
ggggaaactggaactaactactactactacggtatggacgtc

SEQ ID NO: 88 - protein, 5 aa, artificial
  5E3 - CDR-H1
SYSMH

SEQ ID NO: 89 - protein, 17 aa, artificial
  5E3 - CDR-H2
SISSSSSYIYYADSVKG

SEQ ID NO: 90 - protein, 14 aa, artificial
  5E3 - CDR-H3
GETGTNYYYYGMDV

SEQ ID NO: 91 - DNA, 15 bp, artificial
  17H8, 23B6, 28D10 - CDR-H1
agttactactggagc

SEQ ID NO: 92 - DNA, 48 bp, artificial
  17H8, 23B6, 28D10 - CDR-H2
tatatctattacattgggagcaccaactacaacccctccctcaagagt

SEQ ID NO: 93 - DNA, 42 bp, artificial
  17H8, 23B6, 28D10 - CDR-H3
gattcccggtatagaagtggctggtacgatgcttttgatatc

SEQ ID NO: 94 - protein, 5 aa, artificial
  17H8, 23B6, 28D10 - CDR-H1
SYYWS

SEQ ID NO: 95 - protein, 16 aa, artificial
  17H8, 23B6, 28D10 - CDR-H2
YIYYIGSTNYNPSLKS

SEQ ID NO: 96 - protein, 14 aa, artificial
  17H8, 23B6, 28D10 - CDR-H3
DSRYRSGWYDAFDI

SEQ ID NO: 97 - DNA, 15 bp, artificial
  16C1 - CDR-H1
ggttactactggagc

SEQ ID NO: 98 - DNA, 48 bp, artificial; identical to SEQ ID NO: 92
  16C1 - CDR-H2

SEQ ID NO: 99 - DNA, 36 bp, artificial
  16C1 - CDR-H3
gatgggagcagtggctggtaccggtggttcgacccc

SEQ ID NO: 100 - protein, 5 aa, artificial
  16C1 - CDR-H1
GYYWS

SEQ ID NO: 101 - protein, 16 aa, artificial
  16C1 - CDR-H2
YIYYIGSTNYNPSLKS

SEQ ID NO: 102 - protein, 12 aa, artificial
  16C1 - CDR-H3
DGSSGWYRWFDP

SEQ ID NO: 103 - DNA, 15 bp, artificial
  16A4 - CDR-H1
agttactactggagc

SEQ ID NO: 104 - DNA, 48 bp, artificial
  16A4 - CDR-H2
tatatctattacagtgggagcaccaattacaacccctccctcaagagt

SEQ ID NO: 105 - DNA, 51 bp, artificial
  16A4 - CDR-H3
gatcaaaggcggatagcagcagctggtacccacttctacggtatggacgtc

SEQ ID NO: 106 - protein, 5 aa, artificial
  16A4 - CDR-H1
SYYWS

SEQ ID NO: 107 - protein, 16 aa, artificial
  16A4 - CDR-H2
YIYYSGSTNYNPSLKS

SEQ ID NO: 108 - protein, 17 aa, artificial
  16A4 - CDR-H3
DQRRIAAAGTHFYGMDV

SEQ ID NO: 109 - DNA, 15 bp, artificial
  16E2, 17E10, 20B12 - CDR-H1
agctatggcatgcac

SEQ ID NO: 110 - DNA, 51 bp, artificial
  16E2, 17E10, 20B12 - CDR-H2
gtgatatggtatgatggaagtaataaatactatgcagactccgtgaagggc

SEQ ID NO: 111 - DNA, 27 bp, artificial
  16E2, 17E10, 20B12 - CDR-H3
gacgggtgggagctgtcctttgactac

SEQ ID NO: 112 - protein, 5 aa, artificial
  16E2, 17E10, 20B12 - CDR-H1
SYGMH

SEQ ID NO: 113 - protein, 17 aa, artificial
  16E2, 17E10, 20B12 - CDR-H2
VIWYDGSNKYYADSVKG

SEQ ID NO: 114 - protein, 9 aa, artificial
  16E2, 17E10, 20B12 - CDR-H3
DGWELSFDY

SEQ ID NO: 115 - DNA, 15 bp, artificial
  22G10 - CDR-H1
agttatgccatgaac

SEQ ID NO: 116 - DNA, 51 bp, artificial
  22G10 - CDR-H2
actattagtggtggtggtgctaacacatactacgcagactccgtgaagggc

SEQ ID NO: 117 - DNA, 36 bp, artificial
  22G10 - CDR-H3
gggggaatggggggatactactacggtatggacgtc

SEQ ID NO: 118 - protein, 5 aa, artificial
  22G10 - CDR-H1
SYAMN

SEQ ID NO: 119 - protein, 17 aa, artificial
  22G10 - CDR-H2
TISGGGANTYYADSVKG

SEQ ID NO: 120 - protein, 12 aa, artificial
  22G10 - CDR-H3
GGMGGYYYGMDV

SEQ ID NO: 121 - DNA, 15 bp, artificial
  16H2, 20D3, 23E7  - CDR-H1
agctactttattcac

SEQ ID NO: 122 - DNA, 51 bp, artificial
  16H2, 20D3, 23E7  - CDR-H2
ataatcaaccctattagtgttagcacaagctacgcacagaagttccagggc

SEQ ID NO: 123 - DNA, 33 bp, artificial
  16H2, 20D3, 23E7  - CDR-H3
ggggggatacagctatggttacattttgactac

SEQ ID NO: 124 - protein, 5 aa, artificial
  16H2, 20D3, 23E7  - CDR-H1
SYFIH

SEQ ID NO: 125 - protein, 17 aa, artificial
  16H2, 20D3, 23E7  - CDR-H2
IINPISVSTSYAQKFQG

SEQ ID NO: 126 - protein, 11 aa, artificial
  16H2, 20D3, 23E7  - CDR-H3
GGIQLWLHFDY

SEQ ID NO: 127 - DNA, 15 bp, artificial
  22D1 - CDR-H1
agctactttattcac

SEQ ID NO: 128 - DNA, 51 bp, artificial; identical to SEQ ID NO: 122
  22D1 - CDR-H2

SEQ ID NO: 129 - DNA, 33 bp, artificial
  22D1 - CDR-H3
ggggggatacagctatggttacatttggactac

SEQ ID NO: 130 - protein, 5 aa, artificial
  22D1 - CDR-H1
SYFIH

SEQ ID NO: 131 - protein, 17 aa, artificial
  22D1 - CDR-H2
IINPISVSTSYAQKFQG

SEQ ID NO: 132 - protein, 11 aa, artificial
  22D1 - CDR-H3
GGIQLWLHLDY

SEQ ID NO: 133 - DNA, 15 bp, artificial
  25F8 - CDR-H1
agctactatattcac

SEQ ID NO: 134 - DNA, 51 bp, artificial
  25F8 - CDR-H2
ataatcaaccccagtggtggtagcacaaggtacgcacagaagttccagggc

SEQ ID NO: 135 - DNA, 33 bp, artificial
  25F8 - CDR-H3
gggggaatacagctatggttacattttgactac

SEQ ID NO: 136 - protein, 5 aa, artificial
  25F8 - CDR-H1
SYYIH

SEQ ID NO: 137 - protein, 17 aa, artificial
  25F8 - CDR-H2
IINPSGGSTRYAQKFQG

SEQ ID NO: 138 - protein, 11 aa, artificial
  25F8 - CDR-H3
GGIQLWLHFDY

SEQ ID NO: 139 - DNA, 15 bp, artificial
  26F12, 27B3 - CDR-H1
aactactatatgtcc

SEQ ID NO: 140 - DNA, 51 bp, artificial
  26F12, 27B3  - CDR-H2
ataatcaaccctagtggtggtgactcaacctacgcacagaagttccagggc

SEQ ID NO: 141 - DNA, 33 bp, artificial
  26F12, 27B3 - CDR-H3
ggggggatacaactatggttacattttgactac

SEQ ID NO: 142 - protein, 5 aa, artificial
  26F12, 27B3 - CDR-H1
NYYMS

SEQ ID NO: 143 - protein, 17 aa, artificial
  26F12, 27B3 - CDR-H2
IINPSGGDSTYAQKFQG

SEQ ID NO: 144 - protein, 11 aa, artificial
  26F12, 27B3 - CDR-H3
GGIQLWLHFDY

SEQ ID NO: 145 - DNA, 15 bp, artificial
  26D1 - CDR-H1
agctactatatgtcc

SEQ ID NO: 146 - DNA, 51 bp, artificial
  26D1 - CDR-H2
ataatccaccctagtggtggtgacacaacctacgcacagaagttccagggc

SEQ ID NO: 147 - DNA, 33 bp, artificial
  26D1 - CDR-H3
ggggggataaaactatggttacattttgactat

SEQ ID NO: 148 - protein, 5 aa, artificial
  26D1 - CDR-H1
SYYMS

SEQ ID NO: 149 - protein, 17 aa, artificial
  26D1 - CDR-H2
IIHPSGGDTTYAQKFQG

SEQ ID NO: 150 - protein, 11 aa, artificial
  26D1 - CDR-H3
GGIKLWLHFDY

SEQ ID NO: 151 - DNA, 15 bp, artificial
  25G10 - CDR-H1
ggttactactggagc

SEQ ID NO: 152 - DNA, 48 bp, artificial; identical to SEQ ID NO: 92
  25G10  CDR-H2

SEQ ID NO: 153 - DNA, 36 bp, artificial; identical to SEQ ID NO: 99
  25G10 - CDR-H3

SEQ ID NO: 154 - protein, 5 aa, artificial
  25G10 - CDR-H1
GYYWS

SEQ ID NO: 155 - protein, 16 aa, artificial
  25G10 - CDR-H2
YIYYIGSTNYNPSLKS

SEQ ID NO: 156 - protein, 12 aa, artificial
  25G10 - CDR-H3
DGSSGWYRWFDP

SEQ ID NO: 157 - DNA, 15 bp, artificial
  23A10 - CDR-H1
cgctatggcatacac

SEQ ID NO: 158 - DNA, 51 bp, artificial; identical to SEQ ID NO: 2
  23A10 - CDR-H2

SEQ ID NO: 159 - DNA, 48 bp, artificial
  23A10 - CDR-H3
agggccggtatacctggaactacgggctactactatggtatggacgtc

SEQ ID NO: 160 - protein, 5 aa, artificial
  23A10 - CDR-H1
RYGIH

SEQ ID NO: 161 - protein, 17 aa, artificial
  23A10 - CDR-H2
VIWYDGSNKYYADSVKG

SEQ ID NO: 162 - protein, 16 aa, artificial
  23A10 - CDR-H3
RAGIPGTTGYYYGMDV

SEQ ID NO: 163 - DNA, 15 bp, artificial
  19B5 - CDR-H1
agctactttattcac

SEQ ID NO: 164 - DNA, 51 bp, artificial
  19B5 - CDR-H2
attatcaaccctattagtgttagcacaagctacgcacagaagttccagggc

SEQ ID NO: 165 - DNA, 33 bp, artificial; identical to SEQ ID NO: 129
  19B5 - CDR-H3

SEQ ID NO: 166 - protein, 5 aa, artificial
  19B5 - CDR-H1
SYFIH

SEQ ID NO: 167 - protein, 17 aa, artificial
  19B5 - CDR-H2
IINPISVSTSYAQKFQG

SEQ ID NO: 168 - protein, 11 aa, artificial
  19B5 - CDR-H3
GGIQLWLHLDY

SEQ ID NO: 169 - DNA, 33 bp, artificial
  1D10, 2C12  - CDR-L1
tctggagatagattgggggaaaaatatacttgc

SEQ ID NO: 170 - DNA, 21 bp, artificial
  1D10, 2C12 - CDR-L2
caagataccaagcggccctca

SEQ ID NO: 171 - DNA, 27 bp, artificial
  1D10, 2C12 - CDR-L3
caggcgtgggacagcagcactgtggta

SEQ ID NO: 172 - protein, 11 aa, artificial
  1D10, 2C12 - CDR-L1
SGDRLGEKYTC

SEQ ID NO: 173 - protein, 7 aa, artificial
  1D10, 2C12 - CDR-L2
QDTKRPS

SEQ ID NO: 174 - protein, 9 aa, artificial
  1D10, 2C12 - CDR-L3
QAWDSSTVV

SEQ ID NO: 175 - DNA, 36 bp, artificial
  1F10 - CDR-L1
agggccagtcggagtattagcagcagctacttagcc

SEQ ID NO: 176 - DNA, 21 bp, artificial
  1F10 - CDR-L2
ggtccatccagcagggccact

SEQ ID NO: 177 - DNA, 24 bp, artificial
  1F10 - CDR-L3
cagcagtatggtagctcattcact

SEQ ID NO: 178 - protein, 12 aa, artificial
  1F10 - CDR-L1
RASRSISSSYLA

SEQ ID NO: 179 - protein, 7 aa, artificial
  1F10 - CDR-L2
GPSSRAT

SEQ ID NO: 180 - protein, 8 aa, artificial
  1F10 - CDR-L3
QQYGSSFT

SEQ ID NO: 181 - DNA, 48 bp, artificial
  2C12_LC#1 - CDR-L1
aggtctagtcaaagcctcgtatacagtgatggaaacacctacttgaat

SEQ ID NO: 182 - DNA, 21 bp, artificial
  2C12_LC#1 - CDR-L2
aaggtttctaactgggactct

SEQ ID NO: 183 - DNA, 27 bp, artificial
  2C12_LC#1 - CDR-L3
atgcaaggtatagtgtggccgtgcagt

SEQ ID NO: 184 - protein, 16 aa, artificial
  2C12_LC#1 - CDR-L1
RSSQSLVYSDGNTYLN

SEQ ID NO: 185 - protein, 7 aa, artificial
  2C12_LC#1 - CDR-L2
KVSNWDS

SEQ ID NO: 186 - protein, 9 aa, artificial
  2C12_LC#1 - CDR-L3
MQGIVWPCS

SEQ ID NO: 187 - DNA, 48 bp, artificial; identical to SEQ ID NO: 181
  2G6_LC#1 - CDR-L1

SEQ ID NO: 188 - DNA, 21 bp, artificial
  2G6_LC#1 - CDR-L2
caggtttctaactgggactct

SEQ ID NO: 189 - DNA, 27 bp, artificial
  2G6_LC#1 - CDR-L3
atgcaagatacactgtggccgtgcagt

SEQ ID NO: 190 - protein, 16 aa, artificial
  2G6_LC#1 - CDR-L1
RSSQSLVYSDGNTYLN

SEQ ID NO: 191 - protein, 7 aa, artificial
  2G6_LC#1 - CDR-L2
QVSNWDS

SEQ ID NO: 192 - protein, 9 aa, artificial
  2G6_LC#1 - CDR-L3
MQDTLWPCS

SEQ ID NO: 193 - DNA, 33 bp, artificial
  2G6 - CDR-L1
tctggagataggttgggggaaaaatatacttgc

SEQ ID NO: 194 - DNA, 21 bp, artificial
  2G6 - CDR-L2
caagataccaagcggccctca

SEQ ID NO: 195 - DNA, 27 bp, artificial
  2G6 - CDR-L3
caggcgtgggacagcagcactgtggta

SEQ ID NO: 196 - protein, 11 aa, artificial
  2G6 - CDR-L1
SGDRLGEKYTC

SEQ ID NO: 197 - protein, 7 aa, artificial
  2G6 - CDR-L2
QDTKRPS

SEQ ID NO: 198 - protein, 9 aa, artificial
  2G6 - CDR-L3
QAWDSSTVV

SEQ ID NO: 199 - DNA, 33 bp, artificial; identical to SEQ ID NO: 169
  2H12 - CDR-L1

SEQ ID NO: 200 - DNA, 21 bp, artificial
  2H12 - CDR-L2
caagataccaagcggccctca

SEQ ID NO: 201 - DNA, 27 bp, artificial
  2H12 - CDR-L3
caggcgtgggacagcagcactgtggta

SEQ ID NO: 202 - protein, 11 aa, artificial
  2H12 - CDR-L1
SGDRLGEKYTC

SEQ ID NO: 203 - protein, 7 aa, artificial
  2H12 - CDR-L2
QDTKRPS

SEQ ID NO: 204 - protein, 9 aa, artificial
  2H12 - CDR-L3
QAWDSSTVV

SEQ ID NO: 205 - DNA, 48 bp, artificial; identical to SEQ ID NO: 181
  2H12_LC#2 - CDR-L1

SEQ ID NO: 206 - DNA, 21 bp, artificial
  2H12_LC#2 - CDR-L2
aaggtttctaactgggactct

SEQ ID NO: 207 - DNA, 27 bp, artificial
  2H12_LC#2 - CDR-L3
atgcaagatacactgtggccgtgcagt

SEQ ID NO: 208 - protein, 16 aa, artificial
  2H12_LC#2 - CDR-L1
RSSQSLVYSDGNTYLN

SEQ ID NO: 209 - protein, 7 aa, artificial
  2H12_LC#2 - CDR-L2
KVSNWDS

SEQ ID NO: 210 - protein, 9 aa, artificial
  2H12_LC#2 - CDR-L3
MQDTLWPCS

SEQ ID NO: 211 - DNA, 36 bp, artificial
  4A2, 5B4, 5C5  - CDR-L1
agggccagtcggaatattagcagcagctacttagcc

SEQ ID NO: 212 - DNA, 21 bp, artificial
  4A2, 5B4, 5C5  - CDR-L2
ggtccatccagcagggccact

SEQ ID NO: 213 - DNA, 24 bp, artificial
  4A2, 5B4, 5C5  - CDR-L3
cagcagtatggtagctcattcact

SEQ ID NO: 214 - protein, 12 aa, artificial
  4A2, 5B4, 5C5  - CDR-L1
RASRNISSSYLA

SEQ ID NO: 215 - protein, 7 aa, artificial
  4A2, 5B4, 5C5  - CDR-L2
GPSSRAT

SEQ ID NO: 216 - protein, 8 aa, artificial
  4A2, 5B4, 5C5  - CDR-L3
QQYGSSFT

SEQ ID NO: 217 - DNA, 42 bp, artificial
  4A9 - CDR-L1
actgggagcagctccaacatcgggacaggttatgctgtacac

SEQ ID NO: 218 - DNA, 21 bp, artificial
  4A9 - CDR-L2
ggtaacaacaatcggccctca

SEQ ID NO: 219 - DNA, 33 bp, artificial
  4A9 - CDR-L3
cagtcctatgacagcagactgagtggttgggtg

SEQ ID NO: 220 - protein, 14 aa, artificial
  4A9 - CDR-L1
TGSSSNIGTGYAVH

SEQ ID NO: 221 - protein, 7 aa, artificial
  4A9 - CDR-L2
GNNNRPS

SEQ ID NO: 222 - protein, 11 aa, artificial
  4A9 - CDR-L3
QSYDSRLSGWV

SEQ ID NO: 223 - DNA, 36 bp, artificial
  4B10, 4C2 - CDR-L1
agggccagtcagagtgttagcaacacctacttagcc

SEQ ID NO: 224 - DNA, 21 bp, artificial
  4B10, 4C2 - CDR-L2
ggtgcatccagcagggccact

SEQ ID NO: 225 - DNA, 24 bp, artificial
  4B10, 4C2 - CDR-L3
cagcagtacagtaactcgtggacg

SEQ ID NO: 226 - protein, 12 aa, artificial
  4B10, 4C2 - CDR-L1
RASQSVSNTYLA

SEQ ID NO: 227 - protein, 7 aa, artificial
  4B10, 4C2 - CDR-L2
GASSRAT

SEQ ID NO: 228 - protein, 8 aa, artificial
  4B10, 4C2 - CDR-L3
QQYSNSWT

SEQ ID NO: 229 - DNA, 36 bp, artificial; identical to SEQ ID NO: 223
  4D2 - CDR-L1

SEQ ID NO: 230 - DNA, 21 bp, artificial
  4D2 - CDR-L2
ggtgcatccagcagggccgct

SEQ ID NO: 231 - DNA, 24 bp, artificial
  4D2 - CDR-L3
cagcagtatagtaactcgtggacg

SEQ ID NO: 232 - protein, 12 aa, artificial
  4D2 - CDR-L1
RASQSVSNTYLA

SEQ ID NO: 233 - protein, 7 aa, artificial
  4D2 - CDR-L2
GASSRAA

SEQ ID NO: 234 - protein, 8 aa, artificial
  4D2 - CDR-L3
QQYSNSWT

SEQ ID NO: 235 - DNA, 36 bp, artificial
  4D3, 4F3 - CDR-L1
agggccagtcagagtgttagcagcagctacttagcc

SEQ ID NO: 236 - DNA, 21 bp, artificial
  4D3, 4F3 - CDR-L2
ggtgcatccagcagggccact

SEQ ID NO: 237 - DNA, 24 bp, artificial
  4D3, 4F3 - CDR-L3
cagcagtatggtagctcgtggacg

SEQ ID NO: 238 - protein, 12 aa, artificial
  4D3, 4F3 - CDR-L1
RASQSVSSSYLA

SEQ ID NO: 239 - protein, 7 aa, artificial
  4D3, 4F3 - CDR-L2
GASSRAT

SEQ ID NO: 240 - protein, 8 aa, artificial
  4D3, 4F3 - CDR-L3
QQYGSSWT

SEQ ID NO: 241 - DNA, 36 bp, artificial
  4E10 - CDR-L1
agggccagtcagagtgttggcagcagctacttagcc

SEQ ID NO: 242 - DNA, 21 bp, artificial
  4E10 - CDR-L2
ggtgcatccagcagggtcact

SEQ ID NO: 243 - DNA, 24 bp, artificial
  4E10 - CDR-L3
cagcaatatagtaactcgtggacg

SEQ ID NO: 244 - protein, 12 aa, artificial
  4E10 - CDR-L1
RASQSVGSSYLA

SEQ ID NO: 245 - protein, 7 aa, artificial
  4E10 - CDR-L2
GASSRVT

SEQ ID NO: 246 - protein, 8 aa, artificial
  4E10 - CDR-L3
QQYSNSWT

SEQ ID NO: 247 - DNA, 42 bp, artificial
  4F7 - CDR-L1
actgggagcagctccaatatcgggacaggttatgatgtacac

SEQ ID NO: 248 - DNA, 21 bp, artificial
  4F7 - CDR-L2
ggtaacagcaatcggccctca

SEQ ID NO: 249 - protein, 33 aa, artificial
  4F7 - CDR-L3
CAGTCCTATGACAGCAGTCTGAGTGGTTGGGTG

SEQ ID NO: 250 - protein, 14 aa, artificial
  4F7 - CDR-L1
TGSSSNIGTGYDVH

SEQ ID NO: 251 - protein, 7 aa, artificial
  4F7 - CDR-L2
GNSNRPS

SEQ ID NO: 252 - protein, 11 aa, artificial
  4F7 - CDR-L3
QSYDSSLSGWV

SEQ ID NO: 253 - DNA, 33 bp, artificial
  5E3 - CDR-L1
tctggagataaattgggggatgaatatgcttgc

SEQ ID NO: 254 - DNA, 21 bp, artificial
  5E3 - CDR-L2
caagatagcaagcggccctca

SEQ ID NO: 255 - DNA, 27 bp, artificial
  5E3 - CDR-L3
caggcgtgggacagcagcactgtggta

SEQ ID NO: 256 - protein, 11 aa, artificial
  5E3 - CDR-L1
SGDKLGDEYAC

SEQ ID NO: 257 - protein, 7 aa, artificial
  5E3 - CDR-L2
QDSKRPS

SEQ ID NO: 258 - protein, 9 aa, artificial
  5E3 - CDR-L3
QAWDSSTVV

SEQ ID NO: 259 - DNA, 36 bp, artificial
  17H8, 23B6, 28D10 - CDR-L1
agggccagtcagagtgttgccggcagctacctagcc

SEQ ID NO: 260 - DNA, 21 bp, artificial
  17H8, 23B6, 28D10 - CDR-L2
ggtgcatccagcagggccact

SEQ ID NO: 261 - DNA, 27 bp, artificial
  17H8, 23B6, 28D10 - CDR-L3
cagcagtatggtaaatcaccgatcacc

SEQ ID NO: 262 - protein, 12 aa, artificial
  17H8, 23B6, 28D10 - CDR-L1
RASQSVAGSYLA

SEQ ID NO: 263 - protein, 7 aa, artificial
  17H8, 23B6, 28D10 - CDR-L2
GASSRAT

SEQ ID NO: 264 - protein, 9 aa, artificial
  17H8, 23B6, 28D10 - CDR-L3
QQYGKSPIT

SEQ ID NO: 265 - DNA, 36 bp, artificial
  16C1 - CDR-L1
agggccagccagagtgttagcagcagctacttagcc

SEQ ID NO: 266 - DNA, 21 bp, artificial
  16C1 - CDR-L2
ggtgcatccagcagggccact

SEQ ID NO: 267 - DNA, 27 bp, artificial
  16C1 - CDR-L3
cagcagtatggtaactcaccgctcact

SEQ ID NO: 268 - protein, 12 aa, artificial
  16C1 - CDR-L1
RASQSVSSSYLA

SEQ ID NO: 269 - protein, 7 aa, artificial
  16C1 - CDR-L2
GASSRAT

SEQ ID NO: 270 - protein, 9 aa, artificial
  16C1 - CDR-L3
QQYGNSPLT

SEQ ID NO: 271 - DNA, 36 bp, artificial
  16A4 - CDR-L1
agggccagtcagagtgttagcagcagttatttagcc

SEQ ID NO: 272 - DNA, 21 bp, artificial
  16A4 - CDR-L2
ggtacatccagcagggccact

SEQ ID NO: 273 - DNA, 27 bp, artificial
  16A4 - CDR-L3
cagcagtacggtagctcacctttcact

SEQ ID NO: 274 - protein, 12 aa, artificial
  16A4 - CDR-L1
RASQSVSSSYLA

SEQ ID NO: 275 - protein, 7 aa, artificial
  16A4 - CDR-L2
GTSSRAT

SEQ ID NO: 276 - protein, 9 aa, artificial
  16A4 - CDR-L3
QQYGSSPFT

SEQ ID NO: 277 - DNA, 33 bp, artificial
  16E2, 17E10, 20B12  - CDR-L1
cgggcgagtcagggcattagcaattatttagcc

SEQ ID NO: 278 - DNA, 21 bp, artificial
  16E2, 17E10, 20B12  - CDR-L2
gctgcatccagtttgcaaagt

SEQ ID NO: 279 - DNA, 27 bp, artificial
  16E2, 17E10, 20B12  - CDR-L3
caacactattttacttaccctcggacg

SEQ ID NO: 280 - protein, 11 aa, artificial
  16E2, 17E10, 20B12  - CDR-L1
RASQGISNYLA

SEQ ID NO: 281 - protein, 7 aa, artificial
  16E2, 17E10, 20B12  - CDR-L2
AASSLQS

SEQ ID NO: 282 - protein, 9 aa, artificial
  16E2, 17E10, 20B12  - CDR-L3
QHYFTYPRT

SEQ ID NO: 283 - DNA, 33 bp, artificial
  22G10 - CDR-L1
agggccagtcagagtattagcagcaacttagcc

SEQ ID NO: 284 - DNA, 21 bp, artificial
  22G10 - CDR-L2
ggtgcatttaccagggccact

SEQ ID NO: 285 - DNA, 27 bp, artificial
  22G10 - CDR-L3
cagcagtataattactggccgctcact

SEQ ID NO: 286 - protein, 11 aa, artificial
  22G10 - CDR-L1
RASQSISSNLA

SEQ ID NO: 287 - protein, 7 aa, artificial
  22G10 - CDR-L2
GAFTRAT

SEQ ID NO: 288 - protein, 9 aa, artificial
  22G10 - CDR-L3
QQYNYWPLT

SEQ ID NO: 289 - DNA, 39 bp, artificial
  16H2, 20D3, 23E7 - CDR-L1
tctggaagcagctccaacatcggaagtaattttgtaaac

SEQ ID NO: 290 - DNA, 21 bp, artificial
  16H2, 20D3, 23E7 - CDR-L2
actaataatcagcggccctca

SEQ ID NO: 291 - DNA, 33 bp, artificial
  16H2, 20D3, 23E7 - CDR-L3
gcaacatgggatgacagcctgaatggttgggtg

SEQ ID NO: 292 - protein, 13 aa, artificial
  16H2, 20D3, 23E7 - CDR-L1
SGSSSNIGSNFVN

SEQ ID NO: 293 - protein, 7 aa, artificial
  16H2, 20D3, 23E7 - CDR-L2
TNNQRPS

SEQ ID NO: 294 - protein, 11 aa, artificial
  16H2, 20D3, 23E7 - CDR-L3
ATWDDSLNGWV

SEQ ID NO: 295 - DNA, 39 bp, artificial
  22D1 - CDR-L1
tctggaagcagctccaacatcggaagcaattttgtaaac

SEQ ID NO: 296 - DNA, 21 bp, artificial
  22D1 - CDR-L2
actaataatcagcggccctca

SEQ ID NO: 297 - DNA, 33 bp, artificial
  22D1 - CDR-L3
gcaacatgggatgacagtatgaatggttgggtg

SEQ ID NO: 298 - protein, 13 aa, artificial
  22D1 - CDR-L1
SGSSSNIGSNFVN

SEQ ID NO: 299 - protein, 7 aa, artificial
  22D1 - CDR-L2
TNNQRPS

SEQ ID NO: 300 - protein, 11 aa, artificial
  22D1 - CDR-L3
ATWDDSMNGWV

SEQ ID NO: 301 - DNA, 39 bp, artificial
  25F8 - CDR-L1
tctggaagcagctccaacatcggaaggaattttgtaaac

SEQ ID NO: 302 - DNA, 21 bp, artificial
  25F8 - CDR-L2
actaataatcagcggccctca

SEQ ID NO: 303 - DNA, 33 bp, artificial
  25F8 - CDR-L3
gcagcatgggatgacagcctgaatggttgggtg

SEQ ID NO: 304 - protein, 13 aa, artificial
  25F8 - CDR-L1
SGSSSNIGRNFVN

SEQ ID NO: 305 - protein, 7 aa, artificial
  25F8 - CDR-L2
TNNQRPS

SEQ ID NO: 306 - protein, 11 aa, artificial
  25F8 - CDR-L3
AAWDDSLNGWV

SEQ ID NO: 307 - DNA, 39 bp, artificial
  26F12, 27B3 - CDR-L1
tctggaagccgctccaacatcggaagtaattttgtaaac

SEQ ID NO: 308 - DNA, 21 bp, artificial
  26F12, 27B3 - CDR-L2
actaattatcagcggccctca

SEQ ID NO: 309 - DNA, 33 bp, artificial
  26F12, 27B3 - CDR-L3
gcagtatgggatgacagcctgaatggttgggtg

SEQ ID NO: 310 - protein, 13 aa, artificial
  26F12, 27B3 - CDR-L1
SGSRSNIGSNFVN

SEQ ID NO: 311 - protein, 7 aa, artificial
  26F12, 27B3 - CDR-L2
TNYQRPS

SEQ ID NO: 312 - protein, 11 aa, artificial
  26F12, 27B3 - CDR-L3
AVWDDSLNGWV

SEQ ID NO: 313 - DNA, 39 bp, artificial; identical to SEQ ID NO: 307
  26D1 - CDR-L1

SEQ ID NO: 314 - DNA, 21 bp, artificial
  26D1 - CDR-L2
actaataatcagcggccctca

SEQ ID NO: 315 - DNA, 33 bp, artificial; identical to SEQ ID NO: 309
  26D1 - CDR-L3

SEQ ID NO: 316 - protein, 13 aa, artificial
  26D1 - CDR-L1
SGSRSNIGSNFVN

SEQ ID NO: 317 - protein, 7 aa, artificial
  26D1 - CDR-L2
TNNQRPS

SEQ ID NO: 318 - protein, 11 aa, artificial
  26D1 - CDR-L3
AVWDDSLNGWV

SEQ ID NO: 319 - DNA, 36 bp, artificial; identical to SEQ ID NO: 235
  25G10 - CDR-L1

SEQ ID NO: 320 - DNA, 21 bp, artificial
  25G10 - CDR-L2
ggtgcatccagcagggccact

SEQ ID NO: 321 - DNA, 27 bp, artificial
  25G10 - CDR-L3
cagcagtatggtaactcaccgctcact

SEQ ID NO: 322 - protein, 12 aa, artificial
  25G10 - CDR-L1
RASQSVSSSYLA

SEQ ID NO: 323 - protein, 7 aa, artificial
  25G10 - CDR-L2
GASSRAT

SEQ ID NO: 324 - protein, 9 aa, artificial
  25G10 - CDR-L3
QQYGNSPLT

SEQ ID NO: 325 - DNA, 33 bp, artificial
  23A10 - CDR-L1
tctggagatagattgggggagaaatatgtttgc

SEQ ID NO: 326 - DNA, 21 bp, artificial
  23A10 - CDR-L2
caagataataagtggccctca

SEQ ID NO: 327 - DNA, 27 bp, artificial
  23A10 - CDR-L3
caggcgtgggacagcagcactgtggta

SEQ ID NO: 328 - protein, 11 aa, artificial
  23A10 - CDR-L1
SGDRLGEKYVC

SEQ ID NO: 329 - protein, 7 aa, artificial
  23A10 - CDR-L2
QDNKWPS

SEQ ID NO: 330 - protein, 9 aa, artificial
  23A10 - CDR-L3
QAWDSSTVV

SEQ ID NO: 331 - DNA, 39 bp, artificial
  19B5 - CDR-L1
tctggaagcaggtccaacatcggaagcaattttgtaaac

SEQ ID NO: 332 - DNA, 21 bp, artificial
  19B5 - CDR-L2
actaataatcagcggccctca

SEQ ID NO: 333 - DNA, 33 bp, artificial; identical to SEQ ID NO: 297
  19B5 - CDR-L3

SEQ ID NO: 334 - protein, 13 aa, artificial
  19B5 - CDR-L1
SGSRSNIGSNFVN

SEQ ID NO: 335 - protein, 7 aa, artificial
  19B5 - CDR-L2
TNNQRPS

SEQ ID NO: 336 - protein, 11 aa, artificial
  19B5 - CDR-L3
ATWDDSMNGWV

SEQ ID NO: 337 - DNA, 366 bp, artificial
  17H8, 23B6, 28D10 - HCVR
caggtgcagctgcaggagtcgggcccaggactggtgaagccttcggagaccctgtccctcacgtgcactgtctctggtggctccatcaatagttactactggagctggatccggcagcccccagggaagggactggagtggattgggtatatctattacattgggagcaccaactacaacccctccctcaagagtcgcgtcaccatatcagtagacacgtccaagaaccagttctccctgaagctgagctctgtgaccgctgcggacacggccctgtattactgtgcgagagattcccggtatagaagtggctggtacgatgcttttgatatctggggccaagggacaatggtcaccgtctcttca

SEQ ID NO: 338 - protein, 122 aa, artificial
  17H8, 23B6, 28D10 - HCVR
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSS

SEQ ID NO: 339 - DNA, 360 bp, artificial
  4A2, 5B4, 5C5  - HCVR
caggtgcagctgcaggagtcgggcccaggactggtgaagccttcacagaccctgtccctcacctgcactgtctctggtggctccatcagcagtagtggttactactggagctggatccgccagcacccagggaagggcctggagtggattgggtacatctattacactgggagcgcctactacaacccgtccctcaagagtcgagttaccatatcagtagacacgtctaagaaccagttctccctgaagctgagctctgtgactgccgcggacacggccgtgtattactgtgcgagagatggaagcagtggctggtacttccagtattggggccagggcaccctggtcaccgtctcctca

SEQ ID NO: 340 - protein, 120 aa, artificial
  4A2, 5B4, 5C5  - HCVR
QVQLQESGPGLVKPSQTLSLTCTVSGGSISSSGYYWSWIRQHPGKGLEWIGYIYYTGSAYYNPSLKSRVTISVDTSKNQFSLKLSSVTAADTAVYYCARDGSSGWYFQYWGQGTLVTVSS

SEQ ID NO: 341 - DNA, 360 bp, artificial
  16H2, 20D3, 23E7  - HCVR
caggtgcagctggtgcagtctggggctgaggtgaagaagcctggggcctcagtgaaggtttcctgcaaggtttctggatacaccttcaccagctactttattcactgggtgcgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacattttgactactggggccagggaaccctggtcaccgtctcctca

SEQ ID NO: 342 - protein, 120 aa, artificial
  16H2, 20D3, 23E7  - HCVR
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHFDYWGQGTLVTVSS

SEQ ID NO: 343 - DNA, 360 bp, artificial
  26F12, 27B3 - HCVR
caggtgcagttggtgcagtctggggctgaggtgaagaagcctggggcctcagtgaaggtttcctgcaaggcatctagatacaccttcaccaactactatatgtcctgggtgcgacaggcccctggacaagggcttgagtggatgggaataatcaaccctagtggtggtgactcaacctacgcacagaagttccagggcagactcaccatgaccggggacacgtccacgagcacagtctacatggagctgagcagcctgagatctgaggacacggccgtgtattactgtgcgagaggggggatacaactatggttacattttgactactggggccagggaaccctggtcaccgtctcctca

SEQ ID NO: 344 - protein, 120 aa, artificial
  26F12, 27B3 - HCVR
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSS

SEQ ID NO: 345 - DNA, 357 bp, artificial
  4B10, 4C2 - HCVR
caggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagtgtctcctca

SEQ ID NO: 346 - protein, 119 aa, artificial
  4B10, 4C2 - HCVR
QVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSS

SEQ ID NO: 347 - DNA, 357 bp, artificial
  4D3, 4F3 - HCVR
caggtgcagctggtggagtctgggggaggcgtggtccagcctgggaggtccctgagactctcctgtgcagcgtctggattctccttcagtagctatgacatggactgggtccgccagactccaggcaaggggctggagtgggtggcagttatatggtatgatggaagtaataaatactatgcagactccgtgaggggccgattcaccatctccagagacaattccaagaacacgctgtttctgcaaatgaacagcctgagagtcgaggacacggctgtgtattactgtgcgagagaaactggggagggctggtacttcgatctctggggccgtggcaccctggtcactgtctcctca

SEQ ID NO: 348 - protein, 119 aa, artificial
  4D3, 4F3 - HCVR
QVQLVESGGGVVQPGRSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSS

SEQ ID NO: 349 - DNA, 354 bp, artificial
  16E2, 17E10, 20B12  - HCVR
caggtgcagctggtggagtctgggggaggcgtggtccagcctgggaggtccctgagactctcctgtgcagcgtctggattcatcttcagtagctatggcatgcactgggtccgccagactccaggcaaggggctggagtgggtggcagtgatatggtatgatggaagtaataaatactatgcagactccgtgaagggccgattcaccatctccagagacatttccaagaacacgctgtatctgcaaatgaacagcctgagagtcgaggacacggctgtgtattactgtgcgagagacgggtgggagctgtcctttgactactggggccagggaaccctggtcaccgtctcctca

SEQ ID NO: 350 - protein, 118 aa, artificial
  16E2, 17E10, 20B12  - HCVR
QVQLVESGGGVVQPGRSLRLSCAASGFIFSSYGMHWVRQTPGKGLEWVAVIWYDGSNKYYADSVKGRFTISRDISKNTLYLQMNSLRVEDTAVYYCARDGWELSFDYWGQGTLVTVSS

SEQ ID NO: 351 - DNA, 375 bp, artificial
  1D10, 2C12 - HCVR
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtgtcagttatatggtatgatggaagtaataaatactatgcagactccgtgaagggccgattcaccatctccagagacaattccaagaacacgctgtatctgcaaatgaatagcctgagagctgaggacacggctgtgtattactgcgcgagaagggccggtataataggaactacaggctactactacggtatggacgtctggggccaagggaccacggtcaccgtctcctca

SEQ ID NO: 352 - protein, 125 aa, artificial
  1D10, 2C12 - HCVR
QVQLVESGGGVVQPGRSLRLSCAASGFTFSSYGMHWVRQAPGKGLEWVSVIWYDGSNKYYADSVKGRFTISRDNSKNTLYLQMNSLRAEDTAVYYCARRAGIIGTTGYYYGMDVWGQGTTVTVSS

SEQ ID NO: 353 - DNA, 360 bp, artificial
  16C1 - HCVR
caggtgcagctgcaggagtcgggcccaggactggtgaagccttcggagaccctgtccctcacttgtactgtctctggtggctccatcagtggttactactggagctggatccggcagcccccagggaagggactggagtggattgggtatatctattacattgggagcaccaactacaacccctccctcaagagtcgagtcaccatgtcaatagacacgtccaagaaccagttctccctgacgctgagctctttgaccgctgcggacacggccgtgtatttctgtgcgagagatgggagcagtggctggtaccggtggttcgacccctggggccagggaaccctggtcaccgtctcctca

SEQ ID NO: 354 - protein, 120 aa, artificial
  16C1 - HCVR
QVQLQESGPGLVKPSETLSLTCTVSGGSISGYYWSWIRQPPGKGLEWIGYIYYIGSTNYNPSLKSRVTMSIDTSKNQFSLTLSSLTAADTAVYFCARDGSSGWYRWFDPWGQGTLVTVSS

SEQ ID NO: 355 - DNA, 360 bp, artificial
  25G10 - HCVR
caggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacattgggagcaccaactacaacccctccctcaagagtcgagtcaccatgtcagtagacacgtccaagaaccagttctccctgaagctgagctctgtgaccgctgcggacacggccgtgtattactgtgcgagagatgggagcagtggctggtaccggtggttcgacccctggggccagggaaccctggtcaccgtctcctca

SEQ ID NO: 356 - protein, 360 aa, artificial
  25G10 - HCVR
CAGGTGCAGCTGCAGGAGTCGGGCCCAGGACTGGTGAAGCCTTCGGAGACCCTGTCCCTCACCTGCACTGTCTCTGGTGGCTCCATCAGTGGTTACTACTGGAGCTGGATCCGGCAGCCCCCAGGGAAGGGACTGGAGTGGATTGGGTATATCTATTACATTGGGAGCACCAACTACAACCCCTCCCTCAAGAGTCGAGTCACCATGTCAGTAGACACGTCCAAGAACCAGTTCTCCCTGAAGCTGAGCTCTGTGACCGCTGCGGACACGGCCGTGTATTACTGTGCGAGAGATGGGAGCAGTGGCTGGTACCGGTGGTTCGACCCCTGGGGCCAGGGAACCCTGGTCACCGTCTCCTCA

SEQ ID NO: 357 - DNA, 375 bp, artificial
  16A4 - HCVR
caggtgcagctgcaggagtcgggcccaggactggcgaagccttcggagaccctgtccctcacctgcactgtctctggtgactccatcactagttactactggagctggatccggcagcccccagggaagggactggagtggattgggtatatctattacagtgggagcaccaattacaacccctccctcaagagtcgagtcaccatatcagtagacacgtccaagaaccagttctccctgaagctgagttctgtgaccgctgcggacacggccgtgtattactgtgcgagagatcaaaggcggatagcagcagctggtacccacttctacggtatggacgtctggggccaagggaccacggtcaccgtctcctca

SEQ ID NO: 358 - protein, 125 aa, artificial
  16A4 - HCVR
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSS

SEQ ID NO: 359 - DNA, 360 bp, artificial
  1F10 - HCVR
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcacgagtcgagttaccatatcagtagacacgtctaagaaccagttctccctgaagctgagctctgtgactgccgcggacacggccgtgtattactgtgcgagagatggaagcagtggctggtacttccagcactggggccagggcaccctggtcaccgtctcctca

SEQ ID NO: 360 - protein, 120 aa, artificial
  1F10 - HCVR
QVQLQESGPGLVKPSQTLSLTCTVSGGSISSGGYYWSWIRQHPGKGLEWIGYIYYSGSTYYNPSLTSRVTISVDTSKNQFSLKLSSVTAADTAVYYCARDGSSGWYFQHWGQGTLVTVSS

SEQ ID NO: 361 - DNA, 348 bp, artificial
  4A9 - HCVR
caggtgcagctgcaggagtcgggcccaggactggtgaagccttcggagaccctgtccctcacctgcactgtctctggtggctccatcagtggttactactggagctggatccggcagcccccaggaaagggactggagtggtttgcatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctcctca

SEQ ID NO: 362 - protein, 116 aa, artificial
  4A9 - HCVR
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSS

SEQ ID NO: 363 - DNA, 348 bp, artificial
  4F7 - HCVR
caggtgcagctgcaggagtcgggcccaggactggtgaagccttcggagaccctgtccctcacctgcactgtctctggtggctccatcagtagttactcctggagctggatccggcagcccccagggaagggactggagtggattgggtatatctattacagtgggagcaccaactacaacccctccctcaagagtcgagtcaccatatcattagacacgtccaagaaccagttctccctgaagctgagctctgtgaccgctgcggacacggccgtgtattactgtgcgaggaactgggccttccactttgactactggggccagggaaccctggtcaccgtctcctca

SEQ ID NO: 364 - protein, 116 aa, artificial
  4F7 - HCVR
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSS

SEQ ID NO: 365 - DNA, 360 bp, artificial
  22D1 - HCVR
caggtgcagctggtgcagtctggggctgaggtgaagaagcctggggcctcagtgagggtttcctgcaaggtttctggatacaccttcaccagctactttattcactgggtacgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctca

SEQ ID NO: 366 - protein, 120 aa, artificial
  22D1 - HCVR
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSS

SEQ ID NO: 367 - DNA, 360 bp, artificial
  19B5 - HCVR
caggtgcagttggtgcagtctggggctgaggtgaagaagcctggggcctcagtgaaggtttcctgcaaggtttctggatacaccttcaccagctactttattcactgggtgcgccaggcccctggacaagggcttgaatggatgggaattatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctca

SEQ ID NO: 368 - protein, 120 aa, artificial
  19B5 - HCVR
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSS

SEQ ID NO: 369 - DNA, 360 bp, artificial
  25F8 - HCVR
caggtgcagctggtgcagtctggggctgaggtgaagaagcctggggcctcagtgaaggtttcctgcaaggcatctggatacaccttcaccagctactatattcactgggtgcgccaggcccctggacaaggacttgagtggatgggaataatcaaccccagtggtggtagcacaaggtacgcacagaagttccagggcagagtcaccatgaccagggacacgtccacgagcacagtcttcatggagctgagcagcctgagatctgaggacacggccgtgtattactgtgcgcgagggggaatacagctatggttacattttgactactggggccagggaaccctggtcaccgtctcctca

SEQ ID NO: 370 - protein, 120 aa, artificial
  25F8 - HCVR
QVQLVQSGAEVKKPGASVKVSCKASGYTFTSYYIHWVRQAPGQGLEWMGIINPSGGSTRYAQKFQGRVTMTRDTSTSTVFMELSSLRSEDTAVYYCARGGIQLWLHFDYWGQGTLVTVSS

SEQ ID NO: 371 - DNA, 360 bp, artificial
  26D1 - HCVR
caggtgcagttggtgcagtctggggctgaggtgaagaagcctggggcctcagtgaaggtttcctgtaaggcatctagatacaccttcaccagctactatatgtcctgggtgcgacaggcccctggacaagggcttgagtggatgggaataatccaccctagtggtggtgacacaacctacgcacagaagttccagggcagagtcaccatgaccggggacacgtccacgagcacagtctacatggagctgagcagcctgagatctgaggacacggccgtgtattactgtgcgagaggggggataaaactatggttacattttgactattggggccagggaaccctggtcaccgtctcctca

SEQ ID NO: 372 - protein, 120 aa, artificial
  26D1 - HCVR
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSS

SEQ ID NO: 373 - DNA, 357 bp, artificial
  4D2- -HCVR
caggtgcagctggtggagtctgggggaggcgtggtccagcctgggaggtccctgagactctcctgtgcagcctctggattcaccttcagtagttatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagtgtctcctca

SEQ ID NO: 374 - protein, 119 aa, artificial; identical to SEQ ID NO: 346
  4D2- -HCVR

SEQ ID NO: 375 - DNA, 357 bp, artificial
  4E10 - HCVR
caggtgcagctggtggagtctgggggaggcgtggtccagcctgggaggtccctgagactctcctgtgcagcgtctggattcaccttcagtagctatgacatgcactgggtccgccaggctccaggcaaggggctggagtgggtggcagttatatggtatgatggaagtaataaatactatgcagactccgtgaagggccgattcaccatctccagagacaattccacgaacacgctgcatctgcaaatgaacagcccgagagccgaggacacggctgtgtactactgtgcgagagagtataggtacagctggtactttgactactggggccagggaaccctggtcaccgtctcctca

SEQ ID NO: 376 - protein, 119 aa, artificial
  4E10 - HCVR
QVQLVESGGGVVQPGRSLRLSCAASGFTFSSYDMHWVRQAPGKGLEWVAVIWYDGSNKYYADSVKGRFTISRDNSTNTLHLQMNSPRAEDTAVYYCAREYRYSWYFDYWGQGTLVTVSS

SEQ ID NO: 377 - DNA, 363 bp, artificial
  22G10 - HCVR
gaggtgcaactgttggagtctgggggaggcttggtacagcctggggggtccctgagactctcctgtgcagcctctggattcacctttagcagttatgccatgaactgggtccgccaggctccagggaaggggctggagtgggtctcaactattagtggtggtggtgctaacacatactacgcagactccgtgaagggccggttcaccatctccagtgacaattccaagagcacgctgtatctgcaaatgaacagcctgagagccgcggacacggccgtatatcactgtgcgaaagggggaatggggggatactactacggtatggacgtctggggccaagggaccacggtcaccgtctcctca

SEQ ID NO: 378 - protein, 121 aa, artificial
  22G10 - HCVR
EVQLLESGGGLVQPGGSLRLSCAASGFTFSSYAMNWVRQAPGKGLEWVSTISGGGANTYYADSVKGRFTISSDNSKSTLYLQMNSLRAADTAVYHCAKGGMGGYYYGMDVWGQGTTVTVSS

SEQ ID NO: 379 - DNA, 375 bp, artificial; identical to SEQ ID NO: 351
  2C12_LC#1 - HCVR

SEQ ID NO: 380 - protein, 125 aa, artificial; identical to SEQ ID NO: 352
  2C12_LC#1 - HCVR

SEQ ID NO: 381 - DNA, 375 bp, artificial
  2H12_LC#2 - HCVR
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatacagactccgtgaagggccgattcaccatctccagagacaattccaagaacacgctgtatctgcaaatgaatagcctgagagctgaggacacggctgtgtattactgtgcgagaagggccggtataataggaactacaggctactactacggtatggacgtctggggccaagggaccacggtcaccgtctcctca

SEQ ID NO: 382 - protein, 125 aa, artificial
  2H12_LC#2 - HCVR
QVQLVESGGGVVQPGRSLRLSCAASGFTFSSYGMHWVRQAPGKGLEWVAVIWYDGSNKYYTDSVKGRFTISRDNSKNTLYLQMNSLRAEDTAVYYCARRAGIIGTTGYYYGMDVWGQGTTVTVSS

SEQ ID NO: 383 - DNA, 375 bp, artificial
  2G6_LC#1 - HCVR
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctcctca

SEQ ID NO: 384 - protein, 125 aa, artificial
  2G6_LC#1 - HCVR
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSS

SEQ ID NO: 385 - DNA, 375 bp, artificial; identical to SEQ ID NO: 381
  2H12 - HCVR

SEQ ID NO: 386 - protein, 125 aa, artificial; identical to SEQ ID NO: 382
  2H12 - HCVR

SEQ ID NO: 387 - DNA, 375 bp, artificial; identical to SEQ ID NO: 383
  2G6 - HCVR

SEQ ID NO: 388 - protein, 125 aa, artificial; identical to SEQ ID NO: 384
  2G6 - HCVR

SEQ ID NO: 389 - DNA, 375 bp, artificial
  23A10 - HCVR
caggtgcagctggtggagtctgggggaggcgtggtccagcctgggaggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgctaatgaacagcctgagagccgaggactcggctgtgtattactgtgcgagaagggccggtatacctggaactacgggctactactatggtatggacgtctggggccaagggaccacggtcaccgtctcctca

SEQ ID NO: 390 - protein, 125 aa, artificial
  23A10 - HCVR
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSS

SEQ ID NO: 391 - DNA, 369 bp, artificial
  5E3 - HCVR
gaggtgcagttggtggagtctgggggaggcctggtcaagcctggggggtccctgagactctcctgtgcagcctctggattcaccttcagtagctatagcatgcactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaggggaaactggaactaactactactactacggtatggacgtctggggccaagggaccacggtcaccgtctcctca

SEQ ID NO: 392 - protein, 123 aa, artificial
  5E3 - HCVR
EVQLVESGGGLVKPGGSLRLSCAASGFTFSSYSMHWVRQAPGKGLEWVSSISSSSSYIYYADSVKGRFTISRDNAKNSLYLQMNSLRAEDTAVYYCARGETGTNYYYYGMDVWGQGTTVTVSS

SEQ ID NO: 393 - DNA, 327 bp, artificial
  17H8, 23B6, 28D10 -LCVR
gacattgtattgacgcagtctccaggcaccctgtctttgtctccaggggaaagagccaccctctcctgcagggccagtcagagtgttgccggcagctacctagcctggtaccagcagaaacctggccaggctcccaggctcctcatctctggtgcatccagcagggccactggcatcccagacaggttcagtggcagtgggtctgggacagacttcactctcaccatcagcagactggagcctgaagattttgcagtgtattactgtcagcagtatggtaaatcaccgatcaccttcggccaagggacacgactggagatgaaagga

SEQ ID NO: 394 - protein, 109 aa, artificial
  17H8, 23B6, 28D10 -LCVR
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKG

SEQ ID NO: 395 - DNA, 324 bp, artificial
  4A2, 5B4, 5C5 - LCVR
gaaattgtgttgacgcagtctccaggcaccctgtctttgtctccaggggaaagagccaccctctcttgcagggccagtcggaatattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttacagtgtattactgtcagcagtatggtagctcattcactttcggccctgggaccaaagtggatatcaaacga

SEQ ID NO: 396 - protein, 108 aa, artificial
  4A2, 5B4, 5C5 - LCVR
EIVLTQSPGTLSLSPGERATLSCRASRNISSSYLAWYQQKPGQAPRLLIYGPSSRATGIPDRFSGSGSGTDFTLTISRLEPEDFTVYYCQQYGSSFTFGPGTKVDIKR

SEQ ID NO: 397 - DNA, 333 bp, artificial
  16H2, 20D3, 23E7 - LCVR
cagtctgcgctgactcagccaccctcagcgactgggacccccgggcagagggtcaccatctcttgttctggaagcagctccaacatcggaagtaattttgtaaactggtacaaacaactcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagcctgaatggttgggtgttcggcggagggaccaagctgaccgtcctaggt

SEQ ID NO: 398 - protein, 111 aa, artificial
  16H2, 20D3, 23E7 - LCVR
QSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVLG

SEQ ID NO: 399 - DNA, 333 bp, artificial
  26F12, 27B3 - LCVR
cagtctgtgctgactcagtcaccctcagcgtctgggacccccgggcagaaggtcaccatctcttgttctggaagccgctccaacatcggaagtaattttgtaaactggtaccagcagctcccaggaacggcccccaaactcctcatctatactaattatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggt

SEQ ID NO: 400 - protein, 111 aa, artificial
  26F12, 27B3 - LCVR
QSVLTQSPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLG

SEQ ID NO: 401 - DNA, 324 bp, artificial
  4B10, 4C2 - LCVR
gaaattgtattgacgcagtctccaggcaccctgtctttgtctccaggggaaagagccaccctctcctgcagggccagtcagagtgttagcaacacctacttagcctggtaccatcagagacctggccaggctcccaggctcctcatctatggtgcatccagcagggccactggcatcccagacagattcagtggcagtgggtctgggacagacttcgctctcaccatcagcagtctggagcctgaagattttgcagtgtattactgtcagcagtacagtaactcgtggacgttcggccaagggaccaaggtggaaatcaaacga

SEQ ID NO: 402 - protein, 108 aa, artificial
  4B10, 4C2 - LCVR
EIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKR

SEQ ID NO: 403 - DNA, 324 bp, artificial
  4D3, 4F3 - LCVR
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggaacctgaggattttgcagtgtattactgtcagcagtatggtagctcgtggacgttcggccaagggaccaaggtggaaatcaaacga

SEQ ID NO: 404 - protein, 108 aa, artificial
  4D3, 4F3 - LCVR
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIKR

SEQ ID NO: 405 - DNA, 324 bp, artificial
  16E2, 17E10, 20B12 - LCVR
gacatccagatgacccagtctccatcctcactgtctgcatctgtaggagacagagtcaccatcacttgtcgggcgagtcagggcattagcaattatttagcctggttacagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacactattttacttaccctcggacgttcggccaagggaccaaggtggaaatcaaacga

SEQ ID NO: 406 - protein, 108 aa, artificial
  16E2, 17E10, 20B12 - LCVR
DIQMTQSPSSLSASVGDRVTITCRASQGISNYLAWLQQKPGKAPKSLIYAASSLQSGVPSKFSGSGSGTDFTLTISSLQPEDFATYYCQHYFTYPRTFGQGTKVEIKR

SEQ ID NO: 407 - DNA, 321 bp, artificial
  1D10, 2C12 - LCVR
tcctatgcgctgactcagccaccctcagtgtccgtgtccccaggacagacagccagcctcacctgctctggagatagattgggggaaaaatatacttgctggtatcagcagaggccaggccagtcccctttgctggtcatctatcaagataccaagcggccctcagggatccctgagcgattctctggctccacctctggtaacacagccactctgaccatcagcgggacccaggctatggatgaggctgactattactgtcaggcgtgggacagcagcactgtggtattcggcggagggaccaagctgaccgtcctaggt

SEQ ID NO: 408 - protein, 107 aa, artificial
  1D10, 2C12 - LCVR
SYALTQPPSVSVSPGQTASLTCSGDRLGEKYTCWYQQRPGQSPLLVIYQDTKRPSGIPERFSGSTSGNTATLTISGTQAMDEADYYCQAWDSSTVVFGGGTKLTVLG

SEQ ID NO: 409 - DNA, 327 bp, artificial
  16C1 - LCVR
gaaattgtgttgacgcagtctccaggcaccctgtctttgtctccaggggaaagagccaccctctcctgcagggccagccagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcggactggagcctgaagattttgcagtgtatcactgtcagcagtatggtaactcaccgctcactttcggcggagggaccaaggtggagatcaaacga

SEQ ID NO: 410 - protein, 109 aa, artificial
  16C1 - LCVR
EIVLTQSPGTLSLSPGERATLSCRASQSVSSSYLAWYQQKPGQAPRLLIFGASSRATGIPDRFSGSGSGTDFTLTISGLEPEDFAVYHCQQYGNSPLTFGGGTKVEIKR

SEQ ID NO: 411 - DNA, 327 bp, artificial
  25G10 - LCVR
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcagactggagcctgaagattttgcagtgtatcactgtcagcagtatggtaactcaccgctcactttcggcggagggaccaaggtggagatcaaacga

SEQ ID NO: 412 - protein, 109 aa, artificial
  25G10
EIVLTQSPGTLSLSPGERATLSCRASQSVSSSYLAWYQQKPGQAPRLLIFGASSRATGIPDRFSGSGSGTDFTLTISRLEPEDFAVYHCQQYGNSPLTFGGGTKVEIKR

SEQ ID NO: 413 - DNA, 327 bp, artificial
  16A4 - LCVR
gaaattgtgttgacgcagtctccaggcaccctgtctttgtctccaggggaaagagccaccctctcctgcagggccagtcagagtgttagcagcagttatttagcctggtaccagcagaaacctggccaggctcccaggctcctcatctatggtacatccagcagggccactggcatcccagacaggttcagtggcagtgggtctgggacagacttcactctcaccatcagcagactggagcctgaagattttgcagtgtattattgtcagcagtacggtagctcacctttcactttcggcggagggaccaaggtggagatcaaacga

SEQ ID NO: 414 - protein, 109 aa, artificial
  16A4 - LCVR
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKR

SEQ ID NO: 415 - DNA, 324 bp, artificial
  1F10 - LCVR
gaaattgtgttgacgcagtctccaggcaccctgtctttgtctccaggggaaagagccaccctctcctgcagggccagtcggagtattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttgcagtgtattactgtcagcagtatggtagctcattcactttcggccctgggaccaaagtggatatcaaacga

SEQ ID NO: 416 - protein, 108 aa, artificial
  1F10 - LCVR
EIVLTQSPGTLSLSPGERATLSCRASRSISSSYLAWYQQKPGQAPRLLIYGPSSRATGIPDRFSGSGSGTDFTLTISRLEPEDFAVYYCQQYGSSFTFGPGTKVDIKR

SEQ ID NO: 417 - DNA, 336 bp, artificial
  4A9 - LCVR
cagtctgtgctgacgcagccgccctcagtgtctggggccccaggacagagggtcaccatctcctgcactgggagcagctccaacatcgggacaggttatgctgtacactggtaccagcagtttccaggaacagcccccaaactcctcatctatggtaacaacaatcggccctcaggggttcctgaccgattctctggctccaagtctggcacctcagcctccctggccatcactgggctccaggctgaggatgaggctgattattactgccagtcctatgacagcagactgagtggttgggtgttcggcggagggaccaagctgaccgtcctaggt

SEQ ID NO: 418 - protein, 112 aa, artificial
  4A9 - LCVR
QSVLTQPPSVSGAPGQRVTISCTGSSSNIGTGYAVHWYQQFPGTAPKLLIYGNNNRPSGVPDRFSGSKSGTSASLAITGLQAEDEADYYCQSYDSRLSGWVFGGGTKLTVLG

SEQ ID NO: 419 - DNA, 336 bp, artificial
  4F7 - LCVR
cagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatccatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtcctaggt

SEQ ID NO: 420 - protein, 112 aa, artificial
  4F7 - LCVR
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYDSSLSGWVFGGGTRLTVLG

SEQ ID NO: 421 - DNA, 333 bp, artificial
  22D1 - LCVR
cagtctgcgctgactcagccaccctcagcgactgggacccccgggcagagggtcaccatctcttgttctggaagcagctccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagtatgaatggttgggtgttcggcggagggaccaagctgaccgtcctaggt

SEQ ID NO: 422 - protein, 111 aa, artificial
  22D1 - LCVR
QSALTQPPSATGTPGQRVTISCSGSSSNIGSNFVNWYKQLPGTAPKVLIYTNNQRPSGVPDRFSGSKSGTSASLAISGLQSEDESDYYCATWDDSMNGWVFGGGTKLTVLG

SEQ ID NO: 423 - DNA, 333 bp, artificial
  19B5 - LCVR
cagtctgcgctgactcagccaccctcaacgactgggacccccgggcagagggtcaccatctcttgttctggaagcaggtccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgcgcaacatgggatgacagtatgaatggttgggtgttcggcggagggaccaaactgaccgtcctaggt

SEQ ID NO: 424 - protein, 111 aa, artificial
  19B5 - LCVR
QSALTQPPSTTGTPGQRVTISCSGSRSNIGSNFVNWYKQLPGTAPKVLIYTNNQRPSGVPDRFSGSKSGTSASLAISGLQSEDESDYYCATWDDSMNGWVFGGGTKLTVLG

SEQ ID NO: 425 - DNA, 333 bp, artificial
  25F8 - LCVR
cagtctgcgctgactcagccaccctcagcgactgggacccccgggcagagggtcaccatctcttgttctggaagcagctccaacatcggaaggaattttgtaaactggtataagcagctcccaggaacggcccccaaagtcctcatttatactaataatcagcggccctcaggggtccctgaccgattctctggctccaagtctggcacctcagcctccctggccatcagtgggctccagtctgaggatgagtctgattattactgtgcagcatgggatgacagcctgaatggttgggtgttcggcggagggaccaagctgaccgtcctaggt

SEQ ID NO: 426 - protein, 111 aa, artificial
  25F8 - LCVR
QSALTQPPSATGTPGQRVTISCSGSSSNIGRNFVNWYKQLPGTAPKVLIYTNNQRPSGVPDRFSGSKSGTSASLAISGLQSEDESDYYCAAWDDSLNGWVFGGGTKLTVLG

SEQ ID NO: 427 - DNA, 333 bp, artificial
  26D1 - LCVR
cactctgtgctgactcagtcaccctcagcgtctgggacccccggacagagggtcaccatctcttgttctggaagccgctccaacatcggaagtaattttgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggt

SEQ ID NO: 428 - protein, 111 aa, artificial
  26D1 - LCVR
HSVLTQSPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLG

SEQ ID NO: 429 - DNA, 324 bp, artificial
  4D2 - LCVR
gaaattgtattgacgcagtctccaggcaccctgtctttgtctccaggggaaagagccaccctctcctgcagggccagtcagagtgttagcaacacctacttagcctggtaccatcagagacctggccaggctcccaggctcctcatctatggtgcatccagcagggccgctggcatcccagacaggttcagtggcagtgggtctgggacagacttcactctcaccatcagcagactggagcctgaagattttgcagtgtattactgtcagcagtatagtaactcgtggacgttcggccaagggaccaaggtggaaatcaaacga

SEQ ID NO: 430 - protein, 108 aa, artificial
  4D2 - LCVR
EIVLTQSPGTLSLSPGERATLSCRASQSVSNTYLAWYHQRPGQAPRLLIYGASSRAAGIPDRFSGSGSGTDFTLTISRLEPEDFAVYYCQQYSNSWTFGQGTKVEIKR

SEQ ID NO: 431 - DNA, 324 bp, artificial
  4E10 - LCVR
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcatccagcagggtcactggcatcccagacaggttcagtggcagtgggtctgggacagatttcactctcaccatcagcagactggagcctgaagattttgcagtgtattactgtcagcaatatagtaactcgtggacgttcggccaagggaccaaggtggaaatcaaacga

SEQ ID NO: 432 - protein, 108 aa, artificial
  4E10 - LCVR
EIVLTQSPGTLSLSPGERATLSCRASQSVGSSYLAWYQQKPGQAPRLLIYGASSRVTGIPDRFSGSGSGTDFTLTISRLEPEDFAVYYCQQYSNSWTFGQGTKVEIKR

SEQ ID NO: 433 - DNA, 324 bp, artificial
  22G10 - LCVR
gaaatagtgatgacgcagtctccagtcaccctgtctctgtctctaggggaaagagccaccctctcctgcagggccagtcagagtattagcagcaacttagcctggttccagcagaaacctggccaggctcccagactcctcatctatggtgcatttaccagggccactggtatcccagccagggtcagtggcagtgggtctgggacagagttcactctcaccatcagcagcctgcagtctgaagattttgcagtttattactgtcagcagtataattactggccgctcactttcggcggagggaccaaggtggagatcaagcga

SEQ ID NO: 434 - protein, 108 aa, artificial
  22G10 - LCVR
EIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKR

SEQ ID NO: 435 - DNA, 339 bp, artificial
  2C12_LC#1 - LCVR
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtatagtgtggccgtgcagttttggccaggggaccaagctggagatcaaacga

SEQ ID NO: 436 - protein, 113 aa, artificial
  2C12_LC#1 - LCVR
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGIVWPCSFGQGTKLEIKR

SEQ ID NO: 437 - DNA, 339 bp, artificial
  2H12_LC#2 - LCVR
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagaatcagcggcagtgggtcaggcaccgatttcacactgaaaatcagcagggtggaggctgaggatgttggggtttattactgcatgcaagatacactgtggccgtgcagttttggccaggggaccaagctggagatcaaacga

SEQ ID NO: 438 - protein, 113 aa, artificial
  2H12_LC#2 - LCVR
DVVMTQSPLSLPVTLGQPASISCRSSQSLVYSDGNTYLNWFQQRPGQSPRRLIYKVSNWDSGVPDRISGSGSGTDFTLKISRVEAEDVGVYYCMQDTLWPCSFGQGTKLEIKR

SEQ ID NO: 439 - DNA, 339 bp, artificial
  2G6_LC#1 - LCVR
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccacggcgcctaatttatcaggtttctaactgggactctggggtcccagacagattcagcggcagtgggtcaggcactgatttcacactgaaaatcagcagggtggaggctgaggatgttgggatttattactgcatgcaagatacactgtggccgtgcagttttggccaggggaccaagctggagatcaaacga

SEQ ID NO: 440 - protein, 113 aa, artificial
  2G6_LC#1 - LCVR
DVVMTQSPLSLPVTLGQPASISCRSSQSLVYSDGNTYLNWFQQRPGQSPRRLIYQVSNWDSGVPDRFSGSGSGTDFTLKISRVEAEDVGIYYCMQDTLWPCSFGQGTKLEIKR

SEQ ID NO: 441 - DNA, 321 bp, artificial
  2H12 - LCVR
tcctatgagctgactcagccaccctcagtgtccgtgtccccaggacagacagccagcatcacctgctctggagatagattgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccagcctatggatgaggctgactattactgtcaggcgtgggacagcagcactgtggtattcggcggagggaccaagctgaccgtcctaggt

SEQ ID NO: 442 - protein, 107 aa, artificial
  2H12 - LCVR
SYELTQPPSVSVSPGQTASITCSGDRLGEKYTCWYQQRPGQSPLLVIYQDTKRPSGIPERFSGSNSGNTATLTISGTQPMDEADYYCQAWDSSTVVFGGGTKLTVLG

SEQ ID NO: 443 - DNA, 321 bp, artificial
  2G6 - LCVR
tcctatgaactgactcagccaccctcagtgtccgtgtccccaggacagacagccagcatcacctgctctggagataggttgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggacagcagcactgtggtattcggcggagggaccaagctgaccgtcctaggt

SEQ ID NO: 444 - protein, 107 aa, artificial
  2G6 - LCVR
SYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVLG

SEQ ID NO: 445 - DNA, 321 bp, artificial
  23A10 - LCVR
tcctatgagctgactcagccaccctcagtgtccgtgtccccaggacagacagccagcatcacctgctctggagatagattgggggagaaatatgtttgctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtcctaggt

SEQ ID NO: 446 - protein, 107 aa, artificial
  23A10 - LCVR
SYELTQPPSVSVSPGQTASITCSGDRLGEKYVCWYQQKPGQSPILVIYQDNKWPSGIPERFSGSNSGNTATLTISGTQAMDEADYYCQAWDSSTVVFGGGTKLTVLG

SEQ ID NO: 447 - DNA, 321 bp, artificial
  5E3 - LCVR
tcctatgagctgactcagccaccctcagtgtccgtgtccccaggacagacagccagcatcacctgctctggagataaattgggggatgaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtcctaggt

SEQ ID NO: 448 - protein, 107 aa, artificial
  5E3 - LCVR
SYELTQPPSVSVSPGQTASITCSGDKLGDEYACWYQQKPGQSPVLVIYQDSKRPSGIPERFSGSNSGNTATLTISGTQAMDEADYYCQAWDSSTVVFGGGTKLTVLG

SEQ ID NO: 449 - protein, 119 aa, artificial; identical to SEQ ID NO: 348
  4F3 VH

SEQ ID NO: 450 - protein, 116 aa, artificial; identical to SEQ ID NO: 362
  4A9 VH

SEQ ID NO: 451 - protein, 119 aa, artificial; identical to SEQ ID NO: 346
  4B10 VH

SEQ ID NO: 452 - protein, 122 aa, artificial; identical to SEQ ID NO: 338
  17H8.2 VH

SEQ ID NO: 453 - protein, 120 aa, artificial; identical to SEQ ID NO: 354
  16C1.1 VH

SEQ ID NO: 454 - protein, 125 aa, artificial; identical to SEQ ID NO: 358
  16A4.1 VH

SEQ ID NO: 455 - protein, 121 aa, artificial; identical to SEQ ID NO: 378
  22G10.1 VH

SEQ ID NO: 456 - protein, 120 aa, artificial; identical to SEQ ID NO: 342
  20D3.1 VH

SEQ ID NO: 457 - protein, 120 aa, artificial; identical to SEQ ID NO: 366
  22D1.1 VH

SEQ ID NO: 458 - protein, 120 aa, artificial; identical to SEQ ID NO: 370
  25F8.1 VH

SEQ ID NO: 459 - protein, 120 aa, artificial; identical to SEQ ID NO: 344
  26F12.1 VH

SEQ ID NO: 460 - protein, 120 aa, artificial; identical to SEQ ID NO: 372
  26D1.1 VH

SEQ ID NO: 461 - protein, 120 aa, artificial
  25G10.1 VH
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSS

SEQ ID NO: 462 - protein, 120 aa, artificial; identical to SEQ ID NO: 368
  19B5.1 VH

SEQ ID NO: 463 - protein, 120 aa, artificial; identical to SEQ ID NO: 340
  4A2 VH

SEQ ID NO: 464 - protein, 120 aa, artificial
  4A2 (1-472)(Q17E,H47P) VH
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSS

SEQ ID NO: 465 - protein, 120 aa, artificial; identical to SEQ ID NO: 340
  4A2 VH

SEQ ID NO: 466 - protein, 120 aa, artificial; identical to SEQ ID NO: 464
  4A2 (1-472)(Q17E,H47P) VH

SEQ ID NO: 467 - protein, 120 aa, artificial; identical to SEQ ID NO: 464
  4A2 (1-472)(Q17E,H47P,D111E) VH

SEQ ID NO: 468 - protein, 120 aa, artificial; identical to SEQ ID NO: 464
  4A2 (1-472)(Q17E,H47P,D111E,W134Y) VH

SEQ ID NO: 469 - protein, 120 aa, artificial; identical to SEQ ID NO: 464
  4A2 VH

SEQ ID NO: 470 - protein, 120 aa, artificial; identical to SEQ ID NO: 464
  4F3 (1-471)(R17G) VH

SEQ ID NO: 471 - protein, 119 aa, artificial
  4F3 (1-471)(R17G,T47A) VH
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSS

SEQ ID NO: 472 - protein, 119 aa, artificial
  4F3 (1-471)(R17G,T47A,R141Q) VH
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSS

SEQ ID NO: 473 - protein, 119 aa, artificial
  4F3 (1-471)(R17G,T47A,D61E,D72E,R141Q) VH
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSS

SEQ ID NO: 474 - protein, 119 aa, artificial
  4F3 (1-471)(R17G,T47A,D61E,D72E,W134Y,R141Q) VH
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGYYFDLWGQGTLVTVSS

SEQ ID NO: 475 - protein, 125 aa, artificial
  2G6 (1-477)(R17G,D61E,D72E,K94N) VH
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSS

SEQ ID NO: 476 - protein, 120 aa, artificial; identical to SEQ ID NO: 354
  16C1.1 VH

SEQ ID NO: 477 - protein, 120 aa, artificial
  16C1.1 (1-469)(T92K) VH
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGWYRWFDPWGQGTLVTVSS

SEQ ID NO: 478 - protein, 120 aa, artificial
  16C1.1 (1-469)(T92K,D109E) VH
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCAREGSSGWYRWFDPWGQGTLVTVSS

SEQ ID NO: 479 - protein, 120 aa, artificial
  16C1.1 (1-469)(T92K,W132Y,W135Y) VH
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGYYRYFDPWGQGTLVTVSS

SEQ ID NO: 480 - protein, 120 aa, artificial; identical to SEQ ID NO: 477
  16C1.1 (1-469)(T92K) VH

SEQ ID NO: 481 - protein, 122 aa, artificial; identical to SEQ ID NO: 338
  17H8.2 VH

SEQ ID NO: 482 - protein, 122 aa, artificial
  17H8.2 (1-471)(D109E) VH
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGWYDAFDIWGQGTMVTVSS

SEQ ID NO: 483 - protein, 122 aa, artificial
  17H8.2 (1-471)(D109E,W132Y) VH
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGYYDAFDIWGQGTMVTVSS

SEQ ID NO: 484 - protein, 122 aa, artificial; identical to SEQ ID NO: 482
  17H8.2 (1-471)(D109E) VH

SEQ ID NO: 485 - protein, 116 aa, artificial; identical to SEQ ID NO: 364
  4F7 VH

SEQ ID NO: 486 - protein, 116 aa, artificial; identical to SEQ ID NO: 364
  4F7 VH

SEQ ID NO: 487 - protein, 116 aa, artificial
  4F7 (1-468)(W113Y) VH
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNYAFHFDYWGQGTLVTVSS

SEQ ID NO: 488 - protein, 119 aa, artificial
  4B10 (1-471)(R17G,D61E,D72E,W134Y) VH
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDYSFDYWGQGTLVSVSS

SEQ ID NO: 489 - protein, 119 aa, artificial; identical to SEQ ID NO: 346
  4B10 VH

SEQ ID NO: 490 - protein, 119 aa, artificial
  4B10 (1-471)(R17G) VH
QVQLVESGGGVVQPGGSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSS

SEQ ID NO: 491 - protein, 119 aa, artificial
  4B10 (1-471)(R17G,D61E,D72E) VH
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSS

SEQ ID NO: 492 - protein, 116 aa, artificial; identical to SEQ ID NO: 362
  4A9 VH

SEQ ID NO: 493 - protein, 116 aa, artificial
  4A9 (1-468)(F55I,A56G) VH
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNWAFHFDFWGQGTLVTVSS

SEQ ID NO: 494 - protein, 116 aa, artificial; identical to SEQ ID NO: 493
  4A9 (1-468)(F55I,A56G) VH

SEQ ID NO: 495 - protein, 116 aa, artificial
  4A9 (1-468)(F55I,A56G,W113Y) VH
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNYAFHFDFWGQGTLVTVSS

SEQ ID NO: 496 - protein, 120 aa, artificial; identical to SEQ ID NO: 342
  20D3.1 VH

SEQ ID NO: 497 - protein, 120 aa, artificial; identical to SEQ ID NO: 342
  20D3.1 VH

SEQ ID NO: 498 - protein, 120 aa, artificial
  20D3.1 (1-469)(W133Y) VH
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHFDYWGQGTLVTVSS

SEQ ID NO: 499 - protein, 120 aa, artificial; identical to SEQ ID NO: 498
  20D3.1 (1-469)(W133Y) VH

SEQ ID NO: 500 - protein, 120 aa, artificial; identical to SEQ ID NO: 498
  20D3.1 (1-469)(W133Y) VH

SEQ ID NO: 501 - protein, 121 aa, artificial
  22G10.1 (1-470)(S82R,A99E) VH
EVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSS

SEQ ID NO: 502 - protein, 121 aa, artificial; identical to SEQ ID NO: 501
  22G10.1 (1-470)(A99E,H105Y) VH

SEQ ID NO: 503 - protein, 121 aa, artificial
  22G10.1 (1-470)(A99E) VH
EVQLLESGGGLVQPGGSLRLSCAASGFTFSSYAMNWVRQAPGKGLEWVSTISGGGANTYYADSVKGRFTISSDNSKSTLYLQMNSLRAEDTAVYHCAKGGMGGYYYGMDVWGQGTTVTVSS

SEQ ID NO: 504 - protein, 121 aa, artificial; identical to SEQ ID NO: 503
  22G10.1 (1-470)(A99E) VH

SEQ ID NO: 505 - protein, 121 aa, artificial
  22G10.1 (1-470)(D72E,A99E) VH
EVQLLESGGGLVQPGGSLRLSCAASGFTFSSYAMNWVRQAPGKGLEWVSTISGGGANTYYAESVKGRFTISSDNSKSTLYLQMNSLRAEDTAVYHCAKGGMGGYYYGMDVWGQGTTVTVSS

SEQ ID NO: 506 - protein, 121 aa, artificial
  22G10.1 (1-470)(H105Y) VH
EVQLLESGGGLVQPGGSLRLSCAASGFTFSSYAMNWVRQAPGKGLEWVSTISGGGANTYYADSVKGRFTISSDNSKSTLYLQMNSLRAADTAVYYCAKGGMGGYYYGMDVWGQGTTVTVSS

SEQ ID NO: 507 - protein, 125 aa, artificial
  16A4.1 (1-474)(T144L) VH
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSS

SEQ ID NO: 508 - protein, 120 aa, artificial; identical to SEQ ID NO: 368
  19B5.1 VH

SEQ ID NO: 509 - protein, 120 aa, artificial
  19B5.1 (1-469)(W133Y) VH
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSS

SEQ ID NO: 510 - protein, 120 aa, artificial; identical to SEQ ID NO: 368
  19B5.1 VH

SEQ ID NO: 511 - protein, 120 aa, artificial; identical to SEQ ID NO: 368
  19B5.1 VH

SEQ ID NO: 512 - protein, 120 aa, artificial; identical to SEQ ID NO: 509
  19B5.1 (1-469)(W133Y) VH

SEQ ID NO: 513 - protein, 125 aa, artificial
  23A10.3 (1-474)(L92Q) VH
QVQLVESGGGVVQPGRSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSS

SEQ ID NO: 514 - protein, 125 aa, artificial
  23A10.3 (1-474)(R17G,L92Q) VH
QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSS

SEQ ID NO: 515 - protein, 125 aa, artificial
  23A10.3 (1-474)(R17G,D61E,D72E,L92Q) VH
QVQLVESGGGVVQPGGSLRLSCAASGFTFSRYGIHWVRQAPGKGLEWVAVIWYEGSNKYYAESVKGRFTISRDNSKNTLYLQMNSLRAEDSAVYYCARRAGIPGTTGYYYGMDVWGQGTTVTVSS

SEQ ID NO: 516 - protein, 125 aa, artificial; identical to SEQ ID NO: 390
  23A10.3 VH

SEQ ID NO: 517 - protein, 120 aa, artificial; identical to SEQ ID NO: 461
  25G10.1 VH

SEQ ID NO: 518 - protein, 120 aa, artificial
  25G10.1 (1-469)(D109E,W132Y,W135Y) VH
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCAREGSSGYYRYFDPWGQGTLVTVSS

SEQ ID NO: 519 - protein, 120 aa, artificial; identical to SEQ ID NO: 372
  26D1.1 VH

SEQ ID NO: 520 - protein, 120 aa, artificial; identical to SEQ ID NO: 372
  26D1.1 VH

SEQ ID NO: 521 - protein, 120 aa, artificial; identical to SEQ ID NO: 372
  26D1.1 VH

SEQ ID NO: 522 - protein, 120 aa, artificial; identical to SEQ ID NO: 372
  26D1.1 VH

SEQ ID NO: 523 - protein, 120 aa, artificial
  26D1.1 (1-469)(W133Y) VH
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLYLHFDYWGQGTLVTVSS

SEQ ID NO: 524 - protein, 120 aa, artificial
  26D1.1 (1-469)(R27G,G82R) VH
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSS

SEQ ID NO: 525 - protein, 120 aa, artificial; identical to SEQ ID NO: 344
  26F12.1 VH

SEQ ID NO: 526 - protein, 120 aa, artificial; identical to SEQ ID NO: 344
  26F12.1 VH

SEQ ID NO: 527 - protein, 120 aa, artificial
  26F12.1 (1-469)(W133Y) VH
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLYLHFDYWGQGTLVTVSS

SEQ ID NO: 528 - protein, 120 aa, artificial; identical to SEQ ID NO: 527
  26F12.1 (1-469)(W133Y) VH

SEQ ID NO: 529 - protein, 120 aa, artificial; identical to SEQ ID NO: 370
  25F8.1 VH

SEQ ID NO: 530 - protein, 120 aa, artificial; identical to SEQ ID NO: 370
  25F8.1 VH

SEQ ID NO: 531 - protein, 120 aa, artificial
  25F8.1 (1-469)(F90Y) VH
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLWLHFDYWGQGTLVTVSS

SEQ ID NO: 532 - protein, 120 aa, artificial; identical to SEQ ID NO: 531
  25F8.1 (1-469)(F90Y) VH

SEQ ID NO: 533 - protein, 120 aa, artificial
  25F8.1 (1-469)(F90Y,W133Y) VH
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLYLHFDYWGQGTLVTVSS

SEQ ID NO: 534 - protein, 120 aa, artificial; identical to SEQ ID NO: 366
  22D1.1 VH

SEQ ID NO: 535 - protein, 120 aa, artificial; identical to SEQ ID NO: 366
  22D1.1 VH

SEQ ID NO: 536 - protein, 120 aa, artificial
  22D1.1 (1-469)(W133Y) VH
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSS

SEQ ID NO: 537 - protein, 120 aa, artificial; identical to SEQ ID NO: 536
  22D1.1 (1-469)(W133Y) VH

SEQ ID NO: 538 - protein, 120 aa, artificial
  22D1.1 (1-469)(F90Y) VH
QVQLVQSGAEVKKPGASVRVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSS

SEQ ID NO: 539 - protein, 116 aa, artificial; identical to SEQ ID NO: 364
  4F7 VH

SEQ ID NO: 540 - protein, 125 aa, artificial; identical to SEQ ID NO: 384
  2G6 VH

SEQ ID NO: 541 - protein, 125 aa, artificial
  2G6 (1-477)(R17G,K94N) VH
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSS

SEQ ID NO: 542 - protein, 125 aa, artificial
  2G6 (1-477)(D61E,D72E) VH
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSS

SEQ ID NO: 543 - protein, 125 aa, artificial
  2G6 (1-477)(R17G) VH
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSS

SEQ ID NO: 544 - protein, 108 aa, artificial; identical to SEQ ID NO: 404
  4F3 VL

SEQ ID NO: 545 - protein, 112 aa, artificial; identical to SEQ ID NO: 418
  4A9 VL

SEQ ID NO: 546 - protein, 108 aa, artificial; identical to SEQ ID NO: 402
  4B10 VL

SEQ ID NO: 547 - protein, 109 aa, artificial; identical to SEQ ID NO: 394
  17H8.2 VL

SEQ ID NO: 548 - protein, 109 aa, artificial; identical to SEQ ID NO: 410
  16C1.1 VL

SEQ ID NO: 549 - protein, 109 aa, artificial; identical to SEQ ID NO: 414
  16A4.1 VL

SEQ ID NO: 550 - protein, 108 aa, artificial; identical to SEQ ID NO: 434
  22G10.1 VL

SEQ ID NO: 551 - protein, 111 aa, artificial; identical to SEQ ID NO: 398
  20D3.1 VL

SEQ ID NO: 552 - protein, 111 aa, artificial; identical to SEQ ID NO: 422
  22D1.1 VL

SEQ ID NO: 553 - protein, 111 aa, artificial; identical to SEQ ID NO: 426
  25F8.1 VL

SEQ ID NO: 554 - protein, 111 aa, artificial; identical to SEQ ID NO: 400
  26F12.1 VL

SEQ ID NO: 555 - protein, 111 aa, artificial; identical to SEQ ID NO: 428
  26D1.1 VL

SEQ ID NO: 556 - protein, 109 aa, artificial; identical to SEQ ID NO: 412
  25G10.1 VL

SEQ ID NO: 557 - protein, 111 aa, artificial; identical to SEQ ID NO: 424
  19B5.1 VL

SEQ ID NO: 558 - protein, 108 aa, artificial
  4A2 (1-236)(N30Q) VL
EIVLTQSPGTLSLSPGERATLSCRASRQISSSYLAWYQQKPGQAPRLLIYGPSSRATGIPDRFSGSGSGTDFTLTISRLEPEDFTVYYCQQYGSSFTFGPGTKVDIKR

SEQ ID NO: 559 - protein, 108 aa, artificial
  4A2 (1-236)(N30Q,T102A,P141Q) VL
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIKR

SEQ ID NO: 560 - protein, 108 aa, artificial
  4A2 (1-236)(N30Q,T102A) VL
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGPGTKVDIKR

SEQ ID NO: 561 - protein, 108 aa, artificial; identical to SEQ ID NO: 560
  4A2 (1-236)(N30Q,T102A) VL

SEQ ID NO: 562 - protein, 108 aa, artificial; identical to SEQ ID NO: 559
  4A2 (1-236)(N30Q,T102A,P141Q) VL

SEQ ID NO: 563 - protein, 108 aa, artificial; identical to SEQ ID NO: 559
  4A2 (1-236)(N30Q,T102A,P141Q) VL

SEQ ID NO: 564 - protein, 108 aa, artificial
  4A2 (1-236)(R29Q,N30S) VL
EIVLTQSPGTLSLSPGERATLSCRASQSISSSYLAWYQQKPGQAPRLLIYGPSSRATGIPDRFSGSGSGTDFTLTISRLEPEDFTVYYCQQYGSSFTFGPGTKVDIKR

SEQ ID NO: 565 - protein, 108 aa, artificial; identical to SEQ ID NO: 404
  4F3 VL

SEQ ID NO: 566 - protein, 108 aa, artificial; identical to SEQ ID NO: 404
  4F3 VL

SEQ ID NO: 567 - protein, 108 aa, artificial; identical to SEQ ID NO: 404
  4F3 VL

SEQ ID NO: 568 - protein, 108 aa, artificial; identical to SEQ ID NO: 404
  4F3 VL

SEQ ID NO: 569 - protein, 108 aa, artificial; identical to SEQ ID NO: 404
  4F3 VL

SEQ ID NO: 570 - protein, 107 aa, artificial
  2G6 (1-234)(C42S,D110E) VL
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLG

SEQ ID NO: 571 - protein, 109 aa, artificial
  16C1.1 (1-235)(H105Y) VL
EIVLTQSPGTLSLSPGERATLSCRASQSVSSSYLAWYQQKPGQAPRLLIFGASSRATGIPDRFSGSGSGTDFTLTISGLEPEDFAVYYCQQYGNSPLTFGGGTKVEIKR

SEQ ID NO: 572 - protein, 109 aa, artificial; identical to SEQ ID NO: 571
  16C1.1 (1-235)(H105Y) VL

SEQ ID NO: 573 - protein, 109 aa, artificial; identical to SEQ ID NO: 571
  16C1.1 (1-235)(H105Y) VL

SEQ ID NO: 574 - protein, 109 aa, artificial; identical to SEQ ID NO: 571
  16C1.1 (1-235)(H105Y) VL

SEQ ID NO: 575 - protein, 109 aa, artificial
  16C1.1 (1-235)(G95R,H105Y,G141Q) VL
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGQGTKVEIKR

SEQ ID NO: 576 - protein, 109 aa, artificial
  17H8.2 (1-235)(G149R) VL
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKR

SEQ ID NO: 577 - protein, 109 aa, artificial; identical to SEQ ID NO: 576
  17H8.2 (1-235)(G149R) VL

SEQ ID NO: 578 - protein, 109 aa, artificial; identical to SEQ ID NO: 576
  17H8.2 (1-235)(G149R) VL

SEQ ID NO: 579 - protein, 109 aa, artificial
  17H8.2 (1-235)(S57Y,G149R) VL
DIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKR

SEQ ID NO: 580 - protein, 112 aa, artificial
  4F7 (1-239)(H57Y) VL
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGGGTRLTVLG

SEQ ID NO: 581 - protein, 112 aa, artificial
  4F7 (1-239)(H57Y,D110E) VL
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYESSLSGWVFGGGTRLTVLG

SEQ ID NO: 582 - protein, 112 aa, artificial
  4F7 (1-239)(D110E) VL
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYESSLSGWVFGGGTRLTVLG

SEQ ID NO: 583 - protein, 108 aa, artificial
  4B10 (1-236)(H45Q,A90T) VL
EIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKR

SEQ ID NO: 584 - protein, 108 aa, artificial; identical to SEQ ID NO: 583
  4B10 (1-236)(H45Q,A90T) VL

SEQ ID NO: 585 - protein, 108 aa, artificial; identical to SEQ ID NO: 583
  4B10 (1-236)(H45Q,A90T) VL

SEQ ID NO: 586 - protein, 108 aa, artificial; identical to SEQ ID NO: 583
  4B10 (1-236)(H45Q,A90T) VL

SEQ ID NO: 587 - protein, 112 aa, artificial
  4A9 (1-239)(F47L) VL
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVLG

SEQ ID NO: 588 - protein, 112 aa, artificial; identical to SEQ ID NO: 587
  4A9 (1-239)(F47L) VL

SEQ ID NO: 589 - protein, 112 aa, artificial
  4A9 (1-239)(F47L,D110E) VL
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYESRLSGWVFGGGTKLTVLG

SEQ ID NO: 590 - protein, 112 aa, artificial; identical to SEQ ID NO: 589
  4A9 (1-239)(F47L,D110E) VL

SEQ ID NO: 591 - protein, 111 aa, artificial
  20D3.1 (1-235)(S102A) VL
QSALTQPPSATGTPGQRVTISCSGSSSNIGSNFVNWYKQLPGTAPKVLIYTNNQRPSGVPDRFSGSKSGTSASLAISGLQSEDEADYYCATWDDSLNGWVFGGGTKLTVLG

SEQ ID NO: 592 - protein, 111 aa, artificial
  20D3.1 (1-235)(K45Q,S102A) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDDSLNGWVFGGGTKLTVLG

SEQ ID NO: 593 - protein, 111 aa, artificial; identical to SEQ ID NO: 592
  20D3.1 (1-235)(K45Q,S102A) VL

SEQ ID NO: 594 - protein, 111 aa, artificial
  20D3.1 (1-235)(K45Q,S102A,D111E,N135Q) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDESLQGWVFGGGTKLTVLG

SEQ ID NO: 595 - protein, 111 aa, artificial
  20D3.1 (1-235)(W109Y) VL
QSALTQPPSATGTPGQRVTISCSGSSSNIGSNFVNWYKQLPGTAPKVLIYTNNQRPSGVPDRFSGSKSGTSASLAISGLQSEDESDYYCATYDDSLNGWVFGGGTKLTVLG

SEQ ID NO: 596 - protein, 108 aa, artificial; identical to SEQ ID NO: 434
  22G10.1 VL

SEQ ID NO: 597 - protein, 108 aa, artificial; identical to SEQ ID NO: 434
  22G10.1 VL

SEQ ID NO: 598 - protein, 108 aa, artificial
  22G10.1 (1-234)(Q97E,S98P) VL
EIVMTQSPVTLSLSLGERATLSCRASQSISSNLAWFQQKPGQAPRLLIYGAFTRATGIPARVSGSGSGTEFTLTISSLEPEDFAVYYCQQYNYWPLTFGGGTKVEIKR

SEQ ID NO: 599 - protein, 108 aa, artificial
  22G10.1 (1-234)(V78F,Q97E,S98P) VL
EIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKR

SEQ ID NO: 600 - protein, 108 aa, artificial; identical to SEQ ID NO: 599
  22G10.1 (1-234)(V78F,Q97E,S98P) VL

SEQ ID NO: 601 - protein, 108 aa, artificial; identical to SEQ ID NO: 434
  22G10.1 VL

SEQ ID NO: 602 - protein, 109 aa, artificial
  16A4.1 (1-235)(G141Q) VL
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGQGTKVEIKR

SEQ ID NO: 603 - protein, 111 aa, artificial
  19B5.1 (1-235)(K45Q,S102A) VL
QSALTQPPSTTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLG

SEQ ID NO: 604 - protein, 111 aa, artificial; identical to SEQ ID NO: 603
  19B5.1 (1-235)(K45Q,S102A) VL

SEQ ID NO: 605 - protein, 111 aa, artificial
  19B5.1 (1-235)(T11V,K45Q,S102A) VL
QSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLG

SEQ ID NO: 606 - protein, 111 aa, artificial
  19B5.1 (1-235)(T11V,K45Q,S102A,D111E,N135Q) VL
QSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVLG

SEQ ID NO: 607 - protein, 111 aa, artificial
  19B5.1 (1-235)(T11V,K45Q,S102A,W109Y,D111E,N135Q) VL
QSALTQPPSVTGTPGQRVTISCSGSRSNIGSNFVNWYQQLPGTAPKVLIYTNNQRPSGVPDRFSGSKSGTSASLAISGLQSEDEADYYCATYDESMQGWVFGGGTKLTVLG

SEQ ID NO: 608 - protein, 107 aa, artificial
  23A10.3 (1-231)(C42S) VL
SYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLG

SEQ ID NO: 609 - protein, 107 aa, artificial; identical to SEQ ID NO: 608
  23A10.3 (1-231)(C42S) VL

SEQ ID NO: 610 - protein, 107 aa, artificial
  23A10.3 (1-231)(C42S,D110E) VL
SYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVLG

SEQ ID NO: 611 - protein, 107 aa, artificial
  23A10.3 (1-231)(C42Y) VL
SYELTQPPSVSVSPGQTASITCSGDRLGEKYVYWYQQKPGQSPILVIYQDNKWPSGIPERFSGSNSGNTATLTISGTQAMDEADYYCQAWDSSTVVFGGGTKLTVLG

SEQ ID NO: 612 - protein, 109 aa, artificial
  25G10.1 (1-235)(H105Y) VL
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGGGTKVEIKR

SEQ ID NO: 613 - protein, 109 aa, artificial; identical to SEQ ID NO: 612
  25G10.1 (1-235)(H105Y) VL

SEQ ID NO: 614 - protein, 111 aa, artificial
  26D1.1 (1-235)(S7P) VL
HSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLG

SEQ ID NO: 615 - protein, 111 aa, artificial
  26D1.1 (1-235)(H1Q,S7P) VL
QSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLG

SEQ ID NO: 616 - protein, 111 aa, artificial
  26D1.1 (1-235)(H1Q,S7P,W109Y) VL
QSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVLG

SEQ ID NO: 617 - protein, 111 aa, artificial
  26D1.1 (1-235)(H1Q,S7P,W109Y,D111E,N135Q) VL
QSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLG

SEQ ID NO: 618 - protein, 111 aa, artificial; identical to SEQ ID NO: 617
  26D1.1 (1-235)(H1Q,S7P,W109Y,D111E,N135Q) VL

SEQ ID NO: 619 - protein, 111 aa, artificial; identical to SEQ ID NO: 615
  26D1.1 (1-235)(H1Q,S7P) VL

SEQ ID NO: 620 - protein, 111 aa, artificial
  26F12.1 (1-235)(S7P) VL
QSVLTQPPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLG

SEQ ID NO: 621 - protein, 111 aa, artificial
  26F12.1 (1-235)(S7P,D111E) VL
QSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLG

SEQ ID NO: 622 - protein, 111 aa, artificial; identical to SEQ ID NO: 621
  26F12.1 (1-235)(S7P,D111E) VL

SEQ ID NO: 623 - protein, 111 aa, artificial
  26F12.1 (1-235)(S7P,W109Y,D111E,N135Q) VL
QSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLG

SEQ ID NO: 624 - protein, 111 aa, artificial
  25F8.1 (1-235)(K45Q) VL
QSALTQPPSATGTPGQRVTISCSGSSSNIGRNFVNWYQQLPGTAPKVLIYTNNQRPSGVPDRFSGSKSGTSASLAISGLQSEDESDYYCAAWDDSLNGWVFGGGTKLTVLG

SEQ ID NO: 625 - protein, 111 aa, artificial
  25F8.1 (1-235)(K45Q,S102A) VL
QSALTQPPSATGTPGQRVTISCSGSSSNIGRNFVNWYQQLPGTAPKVLIYTNNQRPSGVPDRFSGSKSGTSASLAISGLQSEDEADYYCAAWDDSLNGWVFGGGTKLTVLG

SEQ ID NO: 626 - protein, 111 aa, artificial; identical to SEQ ID NO: 625
  25F8.1 (1-235)(K45Q,S102A) VL

SEQ ID NO: 627 - protein, 111 aa, artificial
  25F8.1 (1-235)(K45Q,S102A,D111E) VL
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLNGWVFGGGTKLTVLG

SEQ ID NO: 628 - protein, 111 aa, artificial
  25F8.1 (1-235)(K45Q,S102A,D111E,N135Q) VL
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLQGWVFGGGTKLTVLG

SEQ ID NO: 629 - protein, 111 aa, artificial
  22D1.1 (1-235)(K45Q,S102A) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDDSMNGWVFGGGTKLTVLG

SEQ ID NO: 630 - protein, 111 aa, artificial
  22D1.1 (1-235)(K45Q,S102A,D111E,N135Q) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDESMQGWVFGGGTKLTVLG

SEQ ID NO: 631 - protein, 111 aa, artificial
  22D1.1 (1-235)(K45Q,S102A,W109Y,D111E,N135Q) VL
QSALTQPPSATGTPGQRVTISCSGSSSNIGSNFVNWYQQLPGTAPKVLIYTNNQRPSGVPDRFSGSKSGTSASLAISGLQSEDEADYYCATYDESMQGWVFGGGTKLTVLG

SEQ ID NO: 632 - protein, 111 aa, artificial
  22D1.1 (1-235)(K45Q,S102A,W109Y) VL
QSALTQPPSATGTPGQRVTISCSGSSSNIGSNFVNWYQQLPGTAPKVLIYTNNQRPSGVPDRFSGSKSGTSASLAISGLQSEDEADYYCATYDDSMNGWVFGGGTKLTVLG

SEQ ID NO: 633 - protein, 111 aa, artificial; identical to SEQ ID NO: 629
  22D1.1 (1-235)(K45Q,S102A) VL

SEQ ID NO: 634 - protein, 112 aa, artificial; identical to SEQ ID NO: 420
  4F7 VL

SEQ ID NO: 635 - protein, 107 aa, artificial
  2G6 (1-234)(D110E) VL
SYELTQPPSVSVSPGQTASITCSGDRLGEKYTCWYQQRPGQSPLLVIYQDTKRPSGIPERFSGSNSGNTATLTISGTQAMDEADYYCQAWESSTVVFGGGTKLTVLG

SEQ ID NO: 636 - protein, 107 aa, artificial; identical to SEQ ID NO: 570
  2G6 (1-234)(C42S,D110E) VL

SEQ ID NO: 637 - protein, 107 aa, artificial; identical to SEQ ID NO: 570
  2G6 (1-234)(C42S,D110E) VL

SEQ ID NO: 638 - protein, 107 aa, artificial; identical to SEQ ID NO: 608
  23A10.3 (1-231)(C42S) VL

SEQ ID NO: 639 - DNA, 1368 bp, artificial
  2G6 HC
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 640 - protein, 455 aa, artificial
  2G6 HC
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - DNA, 1353 bp, artificial
  4A2 HC
caggtgcagctgcaggagtcgggcccaggactggtgaagccttcacagaccctgtccctcacctgcactgtctctggtggctccatcagcagtagtggttactactggagctggatccgccagcacccagggaagggcctggagtggattgggtacatctattacactgggagcgcctactacaacccgtccctcaagagtcgagttaccatatcagtagacacgtctaagaaccagttctccctgaagctgagctctgtgactgccgcggacacggccgtgtattactgtgcgagagatggaagcagtggctggtacttccagtattggggccagggcaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 642 - protein, 450 aa, artificial
  4A2 HC
QVQLQESGPGLVKPSQTLSLTCTVSGGSISSSGYYWSWIRQHPGKGLEWIGYIYYTGSAYYNPSLKSRVTISVDTSKNQFSLKLSSVTAADTAVYYCARDGSSGWYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - DNA, 1341 bp, artificial
  4A9 HC
caggtgcagctgcaggagtcgggcccaggactggtgaagccttcggagaccctgtccctcacctgcactgtctctggtggctccatcagtggttactactggagctggatccggcagcccccaggaaagggactggagtggtttgcatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 644 - protein, 446 aa, artificial
  4A9 HC
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 645 - DNA, 1350 bp, artificial
  4B10 HC
caggtgcagctggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagcgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 646 - protein, 449 aa, artificial
  4B10 HC
QVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 647 - DNA, 1350 bp, artificial
  4F3 HC
caggtgcagctggtggagtctgggggaggcgtggtccagcctgggaggtccctgagactctcctgtgcagcgtctggattctccttcagtagctatgacatggactgggtccgccagactccaggcaaggggctggagtgggtggcagttatatggtatgatggaagtaataaatactatgcagactccgtgaggggccgattcaccatctccagagacaattccaagaacacgctgtttctgcaaatgaacagcctgagagtcgaggacacggctgtgtattactgtgcgagagaaactggggagggctggtacttcgatctctggggccgtggcaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 648 - protein, 449 aa, artificial
  4F3 HC
QVQLVESGGGVVQPGRSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 649 - DNA, 1341 bp, artificial
  4F7 HC
caggtgcagctgcaggagtcgggcccaggactggtgaagccttcggagaccctgtccctcacctgcactgtctctggtggctccatcagtagttactcctggagctggatccggcagcccccagggaagggactggagtggattgggtatatctattacagtgggagcaccaactacaacccctccctcaagagtcgagtcaccatatcattagacacgtccaagaaccagttctccctgaagctgagctctgtgaccgctgcggacacggccgtgtattactgtgcgaggaactgggccttccactttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 650 - protein, 446 aa, artificial
  HC
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 651 - DNA, 1368 bp, artificial
  16A4 HC
caggtgcagctgcaggagtcgggcccaggactggcgaagccttcggagaccctgtccctcacctgcactgtctctggtgactccatcactagttactactggagctggatccggcagcccccagggaagggactggagtggattgggtatatctattacagcgggagcaccaattacaacccctccctcaagagtcgagtcaccatatcagtagacacgtccaagaaccagttctccctgaagctgagttctgtgaccgctgcggacacggccgtgtattactgtgcgagagatcaaaggcggatagcagcagctggtacccacttctacggtatggacgtctggggccaagggaccacggtcactgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 652 - protein, 455 aa, artificial
  16A4 HC
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 653 - DNA, 1353 bp, artificial
  16C1 HC
caggtgcagctgcaggagtcgggcccaggactggtgaagccttcggagaccctgtccctcacttgtactgtctctggtggctccatcagtggttactactggagctggatccggcagcccccagggaagggactggagtggattgggtatatctattacattgggagcaccaactacaacccctccctcaagagtcgagtcaccatgtcaatagacacgtccaagaaccagttctccctgacgctgagctctttgaccgctgcggacacggccgtgtatttctgtgcgagagatgggagcagtggctggtaccggtggttcgacccctggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 654 - protein, 450 aa, artificial
  16C1 HC
QVQLQESGPGLVKPSETLSLTCTVSGGSISGYYWSWIRQPPGKGLEWIGYIYYIGSTNYNPSLKSRVTMSIDTSKNQFSLTLSSLTAADTAVYFCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 655 - DNA, 1359 bp, artificial
  17H8 HC
caggtgcagctgcaggagtcgggcccaggactggtgaagccttcggagaccctgtccctcacgtgcactgtctctggtggctccatcaatagttactactggagctggatccggcagcccccagggaagggactggagtggattgggtatatctattacattgggagcaccaactacaacccctccctcaagagtcgcgtcaccatatcagtagacacgtccaagaaccagttctccctgaagctgagctctgtgaccgctgcggacacggccctgtattactgtgcgagagattcccggtatagaagtggctggtacgatgcttttgatatctggggccaagggacaatggtcaccgtctcttcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 656 - protein, 452 aa, artificial
  17H8 HC
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 657 - DNA, 1353 bp, artificial
  19B5 HC
caggtgcagttggtgcagtctggggctgaggtgaagaagcctggggcctcagtgaaggtttcctgcaaggtttctggatacaccttcaccagctactttattcactgggtgcgccaggcccctggacaagggcttgaatggatgggaattatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 658 - protein, 450 aa, artificial
  19B5 HC
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 659 - DNA, 1353 bp, artificial
  20D3 HC
caggtgcagctggtgcagtctggggctgaggtgaagaagcctggggcctcagtgaaggtttcctgcaaggtttctggatacaccttcaccagctactttattcactgggtgcgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacattttgactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 660 - protein, 450 aa, artificial
  20D3 HC
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 661 - DNA, 1353 bp, artificial
  22D1 HC
caggtgcagctggtgcagtctggggctgaggtgaagaagcctggggcctcagtgagggtttcctgcaaggtttctggatacaccttcaccagctactttattcactgggtacgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 662 - protein, 450 aa, artificial
  22D1 HC
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 663 - DNA, 1356 bp, artificial
  22G10 HC
gaggtgcaactgttggagtctgggggaggcttggtacagcctggggggtccctgagactctcctgtgcagcctctggattcacctttagcagttatgccatgaactgggtccgccaggctccagggaaggggctggagtgggtctcaactattagtggtggtggtgctaacacatactacgcagactccgtgaagggccggttcaccatctccagtgacaattccaagagcacgctgtatctgcaaatgaacagcctgagagccgcggacacggccgtatatcactgtgcgaaagggggaatggggggatactactacggtatggacgtctggggccaagggaccacggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 664 - protein, 451 aa, artificial
  22G10 HC
EVQLLESGGGLVQPGGSLRLSCAASGFTFSSYAMNWVRQAPGKGLEWVSTISGGGANTYYADSVKGRFTISSDNSKSTLYLQMNSLRAADTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 665 - DNA, 1368 bp, artificial
  23A10 HC
caggtgcagctggtggagtctgggggaggcgtggtccagcctgggaggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgctaatgaacagcctgagagccgaggactcggctgtgtattactgtgcgagaagggccggtatacctggaactacgggctactactatggtatggacgtctggggccaagggaccacggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 666 - protein, 455 aa, artificial
  23A10 HC
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 667 - DNA, 1353 bp, artificial
  25F8 HC
caggtgcagctggtgcagtctggggctgaggtgaagaagcctggggcctcagtgaaggtttcctgcaaggcatctggatacaccttcaccagctactatattcactgggtgcgccaggcccctggacaaggacttgagtggatgggaataatcaaccccagtggtggtagcacaaggtacgcacagaagttccagggcagagtcaccatgaccagggacacgtccacgagcacagtcttcatggagctgagcagcctgagatctgaggacacggccgtgtattactgtgcgcgagggggaatacagctatggttacattttgactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 668 - protein, 450 aa, artificial
  25F8 HC
QVQLVQSGAEVKKPGASVKVSCKASGYTFTSYYIHWVRQAPGQGLEWMGIINPSGGSTRYAQKFQGRVTMTRDTSTSTVFMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 669 - DNA, 1353 bp, artificial
  25G10 HC
caggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacattgggagcaccaactacaacccctccctcaagagtcgagtcaccatgtcagtagacacgtccaagaaccagttctccctgaagctgagctctgtgaccgctgcggacacggccgtgtattactgtgcgagagatgggagcagtggctggtaccggtggttcgacccctggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 670 - protein, 449 aa, artificial
  25G10 HC
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 671 - DNA, 1353 bp, artificial
  26D1 HC
caggtgcagttggtgcagtctggggctgaggtgaagaagcctggggcctcagtgaaggtttcctgtaaggcatctagatacaccttcaccagctactatatgtcctgggtgcgacaggcccctggacaagggcttgagtggatgggaataatccaccctagtggtggtgacacaacctacgcacagaagttccagggcagagtcaccatgaccggggacacgtccacgagcacagtctacatggagctgagcagcctgagatctgaggacacggccgtgtattactgtgcgagaggggggataaaactatggttacattttgactattggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 672 - protein, 450 aa, artificial
  26D1 HC
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - DNA, 1353 bp, artificial
  26F12 HC
caggtgcagttggtgcagtctggggctgaggtgaagaagcctggggcctcagtgaaggtttcctgcaaggcatctagatacaccttcaccaactactatatgtcctgggtgcgacaggcccctggacaagggcttgagtggatgggaataatcaaccctagtggtggtgactcaacctacgcacagaagttccagggcagactcaccatgaccggggacacgtccacgagcacagtctacatggagctgagcagcctgagatctgaggacacggccgtgtattactgtgcgagaggggggatacaactatggttacattttgactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 674 - protein, 450 aa, artificial
  26F12 HC
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - DNA, 639 bp, artificial
  2G6 LC
tcctatgaactgactcagccaccctcagtgtccgtgtccccaggacagacagccagcatcacctgctctggagataggttgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggacagcagcactgtggtattcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcatga

SEQ ID NO: 676 - protein, 212 aa, artificial
  2G6 LC
SYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 677 - DNA, 645 bp, artificial
  4A2 LC
gaaattgtgttgacgcagtctccaggcaccctgtctttgtctccaggggaaagagccaccctctcctgcagggccagtcggaatattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttacagtgtattactgtcagcagtatggtagctcattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 678 - protein, 214 aa, artificial
  4A2 LC
EIVLTQSPGTLSLSPGERATLSCRASRNISSSYLAWYQQKPGQAPRLLIYGPSSRATGIPDRFSGSGSGTDFTLTISRLEPEDFTVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 679 - DNA, 654 bp, artificial
  4A9 LC
cagtctgtgctgacgcagccgccctcagtgtctggggccccaggacagagggtcaccatctcctgcactgggagcagctccaacatcgggacaggttatgctgtacactggtaccagcagtttccaggaacagcccccaaactcctcatctatggtaacaacaatcggccctcaggggttcctgaccgattctctggctccaagtctggcacctcagcctccctggccatcactgggctccaggctgaggatgaggctgattattactgccagtcctatgacagcagactgagtggttgggtgttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcatga

SEQ ID NO: 680 - protein, 217 aa, artificial
  4A9 LC
QSVLTQPPSVSGAPGQRVTISCTGSSSNIGTGYAVHWYQQFPGTAPKLLIYGNNNRPSGVPDRFSGSKSGTSASLAITGLQAEDEADYYCQSYDSRLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 681 - DNA, 645 bp, artificial
  4B10 LC
gaaattgtattgacgcagtctccaggcaccctgtctttgtctccaggggaaagagccaccctctcctgcagggccagtcagagtgttagcaacacctacttagcctggtaccatcagagacctggccaggctcccaggctcctcatctatggtgcatccagcagggccactggcatcccagacagattcagtggcagtgggtctgggacagacttcgctctcaccatcagcagtctggagcctgaagattttgcagtgtattactgtcagcagtacagtaactcgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 682 - protein, 214 aa, artificial
  4B10 LC
EIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 683 - DNA, 645 bp, artificial
  4F3 LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggaacctgaggattttgcagtgtattactgtcagcagtatggtagctcgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 684 - protein, 214 aa, artificial
  4F3 LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 685 - DNA, 654 bp, artificial
  4F7 LC
cagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatccatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcatga

SEQ ID NO: 686 - protein, 217 aa, artificial
  4F7 LC
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYDSSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 687 - DNA, 648 bp, artificial
  16A4 LC
gaaattgtgttgacgcagtctccaggcaccctgtctttgtctccaggggaaagagccaccctctcctgcagggccagtcagagtgttagcagcagttatttagcctggtaccagcagaaacctggccaggctcccaggctcctcatctatggtacatccagcagggccactggcatcccagacaggttcagtggcagtgggtctgggacagacttcactctcaccatcagcagactggagcctgaagattttgcagtgtattattgtcagcagtacggtagctcacctttcactttcggcggagggaccaaggtggagatcaaacgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 688 - protein, 215 aa, artificial
  16A4 LC
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 689 - DNA, 648 bp, artificial
  16C1 LC
gaaattgtgttgacgcagtctccaggcaccctgtctttgtctccaggggaaagagccaccctctcctgcagggccagccagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcggactggagcctgaagattttgcagtgtatcactgtcagcagtatggtaactcaccgctcactttcggcggagggaccaaggtggagatcaaacgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 690 - protein, 215 aa, artificial
  16C1 LC
EIVLTQSPGTLSLSPGERATLSCRASQSVSSSYLAWYQQKPGQAPRLLIFGASSRATGIPDRFSGSGSGTDFTLTISGLEPEDFAVYHCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 691 - DNA, 648 bp, artificial
  17H8 LC
gacattgtattgacgcagtctccaggcaccctgtctttgtctccaggggaaagagccaccctctcctgcagggccagtcagagtgttgccggcagctacctagcctggtaccagcagaaacctggccaggctcccaggctcctcatctctggtgcatccagcagggccactggcatcccagacaggttcagtggcagtgggtctgggacagacttcactctcaccatcagcagactggagcctgaagattttgcagtgtattactgtcagcagtatggtaaatcaccgatcaccttcggccaagggacacgactggagatgaaaggaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 692 - protein, 215 aa, artificial
  17H8 LC
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 693 - DNA, 651 bp, artificial
  19B5 LC
cagtctgcgctgactcagccaccctcaacgactgggacccccgggcagagggtcaccatctcttgttctggaagcaggtccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgcgcaacatgggatgacagtatgaatggttgggtgttcggcggagggaccaaactgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 694 - protein, 216 aa, artificial
  19B5 LC
QSALTQPPSTTGTPGQRVTISCSGSRSNIGSNFVNWYKQLPGTAPKVLIYTNNQRPSGVPDRFSGSKSGTSASLAISGLQSEDESDYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 695 - DNA, 651 bp, artificial
  20D3 LC
cagtctgcgctgactcagccaccctcagcgactgggacccccgggcagagggtcaccatctcttgttctggaagcagctccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 696 - protein, 216 aa, artificial
  20D3 LC
QSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 697 - DNA, 651 bp, artificial
  22D1 LC
cagtctgcgctgactcagccaccctcagcgactgggacccccgggcagagggtcaccatctcttgttctggaagcagctccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagtatgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 698 - protein, 216 aa, artificial
  22D1 LC
QSALTQPPSATGTPGQRVTISCSGSSSNIGSNFVNWYKQLPGTAPKVLIYTNNQRPSGVPDRFSGSKSGTSASLAISGLQSEDESDYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 699 - DNA, 645 bp, artificial
  22G10 LC
gaaatagtgatgacgcagtctccagtcaccctgtctctgtctctaggggaaagagccaccctctcctgcagggccagtcagagtattagcagcaacttagcctggttccagcagaaacctggccaggctcccagactcctcatctatggtgcatttaccagggccactggtatcccagccagggtcagtggcagtgggtctgggacagagttcactctcaccatcagcagcctgcagtctgaagattttgcagtttattactgtcagcagtataattactggccgctcactttcggcggagggaccaaggtggagatcaagcgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 700 - protein, 214 aa, artificial
  22G10 LC
EIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 701 - DNA, 639 bp, artificial
  23A10 LC
tcctatgagctgactcagccaccctcagtgtccgtgtccccaggacagacagccagcatcacctgctctggagatagattgggggagaaatatgtttgctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 702 - protein, 212 aa, artificial
  23A10 LC
SYELTQPPSVSVSPGQTASITCSGDRLGEKYVCWYQQKPGQSPILVIYQDNKWPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 703 - DNA, 651 bp, artificial
  25F8 LC
cagtctgcgctgactcagccaccctcagcgactgggacccccgggcagagggtcaccatctcttgttctggaagcagctccaacatcggaaggaattttgtaaactggtataagcagctcccaggaacggcccccaaagtcctcatttatactaataatcagcggccctcaggggtccctgaccgattctctggctccaagtctggcacctcagcctccctggccatcagtgggctccagtctgaggatgagtctgattattactgtgcagcatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 704 - protein, 216 aa, artificial
  25F8 LC
QSALTQPPSATGTPGQRVTISCSGSSSNIGRNFVNWYKQLPGTAPKVLIYTNNQRPSGVPDRFSGSKSGTSASLAISGLQSEDESDYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 705 - DNA, 648 bp, artificial
  25G10 LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcagactggagcctgaagattttgcagtgtatcactgtcagcagtatggtaactcaccgctcactttcggcggagggaccaaggtggagatcaaacgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 706 - protein, 215 aa, artificial
  25G10 LC
EIVLTQSPGTLSLSPGERATLSCRASQSVSSSYLAWYQQKPGQAPRLLIFGASSRATGIPDRFSGSGSGTDFTLTISRLEPEDFAVYHCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 707 - DNA, 651 bp, artificial
  26D1 LC
cactctgtgctgactcagtcaccctcagcgtctgggacccccggacagagggtcaccatctcttgttctggaagccgctccaacatcggaagtaattttgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 708 - protein, 216 aa, artificial
  26D1 LC
HSVLTQSPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 709 - DNA, 651 bp, artificial
  26F12 LC
cagtctgtgctgactcagtcaccctcagcgtctgggacccccgggcagaaggtcaccatctcttgttctggaagccgctccaacatcggaagtaattttgtaaactggtaccagcagctcccaggaacggcccccaaactcctcatctatactaattatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 710 - protein, 216 aa, artificial
  26F12 LC
QSVLTQSPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 711 - protein, 449 aa, artificial; identical to SEQ ID NO: 648
  [hu anti-<huCDH19> 4F3 VH]::huIgG1z

SEQ ID NO: 712 - protein, 446 aa, artificial; identical to SEQ ID NO: 644
  HC [hu anti-<huCDH19> 4A9 VH]::huIgG1z

SEQ ID NO: 713 - protein, 449 aa, artificial; identical to SEQ ID NO: 646
  HC [hu anti-<huCDH19> 4B10 VH]::huIgG1z

SEQ ID NO: 714 - protein, 452 aa, artificial; identical to SEQ ID NO: 656
  HC [hu anti-<huCDH19> 17H8.2 VH]::huIgG1z

SEQ ID NO: 715 - protein, 450 aa, artificial; identical to SEQ ID NO: 654
  HC [hu anti-<huCDH19> 16C1.1 VH]::huIgG1z

SEQ ID NO: 716 - protein, 455 aa, artificial; identical to SEQ ID NO: 652
  HC [hu anti-<huCDH19> 16A4.1 VH]::huIgG1z

SEQ ID NO: 717 - protein, 451 aa, artificial; identical to SEQ ID NO: 664
  HC [hu anti-<huCDH19> 22G10.1 VH]::huIgG1z

SEQ ID NO: 718 - protein, 450 aa, artificial; identical to SEQ ID NO: 660
  HC [hu anti-<huCDH19> 20D3.1 VH]::huIgG1z

SEQ ID NO: 719 - protein, 450 aa, artificial; identical to SEQ ID NO: 662
  HC [hu anti-<huCDH19> 22D1.1 VH]::huIgG1z

SEQ ID NO: 720 - protein, 450 aa, artificial; identical to SEQ ID NO: 668
  HC [hu anti-<huCDH19> 25F8.1 VH]::huIgG1z

SEQ ID NO: 721 - protein, 450 aa, artificial; identical to SEQ ID NO: 674
  HC [hu anti-<huCDH19> 26F12.1 VH]::huIgG1z

SEQ ID NO: 722 - protein, 450 aa, artificial; identical to SEQ ID NO: 672
  HC [hu anti-<huCDH19> 26D1.1 VH]::huIgG1z

SEQ ID NO: 723 - protein, 450 aa, artificial
  HC [hu anti-<huCDH19> 25G10.1 VH]::huIgG1z
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 724 - protein, 450 aa, artificial; identical to SEQ ID NO: 658
  HC [hu anti-<huCDH19> 19B5.1 VH]::huIgG1z

SEQ ID NO: 725 - protein, 450 aa, artificial; identical to SEQ ID NO: 642
  HC [hu anti-<huCDH19> 4A2 VH]::huIgG1z

SEQ ID NO: 726 - protein, 450 aa, artificial
  HC [hu anti-<huCDH19> 4A2 (1-472)(Q17E,H47P) VH]::huIgG1z
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 727 - protein, 450 aa, artificial; identical to SEQ ID NO: 642
  HC [hu anti-<huCDH19> 4A2 VH]::huIgG1z

SEQ ID NO: 728 - protein, 450 aa, artificial; identical to SEQ ID NO: 726
  HC [hu anti-<huCDH19> 4A2 (1-472)(Q17E,H47P) VH]::huIgG1z

SEQ ID NO: 729 - protein, 450 aa, artificial
  HC [hu anti-<huCDH19> 4A2 (1-472)(Q17E,H47P,D111E) VH]::huIgG1z
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCAREGSSGWYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 730 - protein, 450 aa, artificial
  HC [hu anti-<huCDH19> 4A2 (1-472)(Q17E,H47P,D111E,W134Y) VH]::huIgG1z
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCAREGSSGYYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 731 - protein, 450 aa, artificial; identical to SEQ ID NO: 642
  HC [hu anti-<huCDH19> 4A2 VH]::huIgG1z

SEQ ID NO: 732 - protein, 449 aa, artificial
  HC [hu anti-<huCDH19> 4F3 (1-471)(R17G) VH]::huIgG1z
QVQLVESGGGVVQPGGSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 733 - protein, 449 aa, artificial
  HC [hu anti-<huCDH19> 4F3 (1-471)(R17G,T47A) VH]::huIgG1z
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 734 - protein, 449 aa, artificial
  HC [hu anti-<huCDH19> 4F3 (1-471)(R17G,T47A,R141Q) VH]::huIgG1z
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 735 - protein, 449 aa, artificial
  HC [hu anti-<huCDH19> 4F3 (1-471)(R17G,T47A,D61E,D72E,R141Q) VH]::huIgG1z
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 736 - protein, 449 aa, artificial
  HC [hu anti-<huCDH19> 4F3 (1-471)(R17G,T47A,D61E,D72E,W134Y,R141Q) VH]::huIgG1z
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGYYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 737 - protein, 455 aa, artificial
  HC [hu anti-<huCDH19> 2G6 (1-477)(R17G,D61E,D72E,K94N) VH]::huIgG1z
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 738 - protein, 450 aa, artificial; identical to SEQ ID NO: 654
  HC [hu anti-<huCDH19> 16C1.1 VH]::huIgG1z

SEQ ID NO: 739 - protein, 450 aa, artificial
  HC [hu anti-<huCDH19> 16C1.1 (1-469)(T92K) VH]::huIgG1z
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 740 - protein, 450 aa, artificial
  HC [hu anti-<huCDH19> 16C1.1 (1-469)(T92K,D109E) VH]::huIgG1z
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCAREGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 741 - protein, 450 aa, artificial
  HC [hu anti-<huCDH19> 16C1.1 (1-469)(T92K,W132Y,W135Y) VH]::huIgG1z
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGYYRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 742 - protein, 450 aa, artificial; identical to SEQ ID NO: 739
  HC [hu anti-<huCDH19> 16C1.1 (1-469)(T92K) VH]::huIgG1z

SEQ ID NO: 743 - protein, 452 aa, artificial; identical to SEQ ID NO: 656
  HC [hu anti-<huCDH19> 17H8.2 VH]::huIgG1z

SEQ ID NO: 744 - protein, 452 aa, artificial
  HC [hu anti-<huCDH19> 17H8.2 (1-471)(D109E) VH]::huIgG1z
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGWYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 745 - protein, 452 aa, artificial
  HC [hu anti-<huCDH19> 17H8.2 (1-471)(D109E,W132Y) VH]::huIgG1z
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGYYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 746 - protein, 452 aa, artificial; identical to SEQ ID NO: 744
  HC [hu anti-<huCDH19> 17H8.2 (1-471)(D109E) VH]::huIgG1z

SEQ ID NO: 747 - protein, 446 aa, artificial; identical to SEQ ID NO: 650
  HC [hu anti-<huCDH19> 4F7 VH]::huIgG1z

SEQ ID NO: 748 - protein, 446 aa, artificial; identical to SEQ ID NO: 650
  HC [hu anti-<huCDH19> 4F7 VH]::huIgG1z

SEQ ID NO: 749 - protein, 446 aa, artificial
  HC [hu anti-<huCDH19> 4F7 (1-468)(W113Y) VH]::huIgG1z
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNYAFHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 750 - protein, 449 aa, artificial
  HC [hu anti-<huCDH19> 4B10 (1-471)(R17G,D61E,D72E,W134Y) VH]::huIgG1z
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDYSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 751 - protein, 449 aa, artificial; identical to SEQ ID NO: 646
  HC [hu anti-<huCDH19> 4B10 VH]::huIgG1z

SEQ ID NO: 752 - protein, 449 aa, artificial
  HC [hu anti-<huCDH19> 4B10 (1-471)(R17G) VH]::huIgG1z
QVQLVESGGGVVQPGGSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 753 - protein, 449 aa, artificial
  HC [hu anti-<huCDH19> 4B10 (1-471)(R17G,D61E,D72E) VH]::huIgG1z
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 754 - protein, 446 aa, artificial; identical to SEQ ID NO: 644
  HC [hu anti-<huCDH19> 4A9 VH]::huIgG1z

SEQ ID NO: 755 - protein, 446 aa, artificial
  HC [hu anti-<huCDH19> 4A9 (1-468)(F55I,A56G) VH]::huIgG1z
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNWAFHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 756 - protein, 446 aa, artificial; identical to SEQ ID NO: 755
  HC [hu anti-<huCDH19> 4A9 (1-468)(F55I,A56G) VH]::huIgG1z

SEQ ID NO: 757 - protein, 446 aa, artificial
  HC [hu anti-<huCDH19> 4A9 (1-468)(F55I,A56G,W113Y) VH]::huIgG1z
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNYAFHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 758 - protein, 450 aa, artificial; identical to SEQ ID NO: 660
  HC [hu anti-<huCDH19> 20D3.1 VH]::huIgG1z

SEQ ID NO: 759 - protein, 450 aa, artificial; identical to SEQ ID NO: 660
  HC [hu anti-<huCDH19> 20D3.1 VH]::huIgG1z

SEQ ID NO: 760 - protein, 450 aa, artificial
  HC [hu anti-<huCDH19> 20D3.1 (1-469)(W133Y) VH]::huIgG1z
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 761 - protein, 450 aa, artificial; identical to SEQ ID NO: 760
  HC [hu anti-<huCDH19> 20D3.1 (1-469)(W133Y) VH]::huIgG1z

SEQ ID NO: 762 - protein, 450 aa, artificial; identical to SEQ ID NO: 760
  HC [hu anti-<huCDH19> 20D3.1 (1-469)(W133Y) VH]::huIgG1z

SEQ ID NO: 763 - protein, 451 aa, artificial
  HC [hu anti-<huCDH19> 22G10.1 (1-470)(S82R,A99E) VH]::huIgG1z
EVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 764 - protein, 451 aa, artificial
  HC [hu anti-<huCDH19> 22G10.1 (1-470)(A99E,H105Y) VH]::huIgG1z
EVQLLESGGGLVQPGGSLRLSCAASGFTFSSYAMNWVRQAPGKGLEWVSTISGGGANTYYADSVKGRFTISSDNSKSTLYLQMNSLRAEDTAVYYCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 765 - protein, 451 aa, artificial
  HC [hu anti-<huCDH19> 22G10.1 (1-470)(A99E) VH]::huIgG1z
EVQLLESGGGLVQPGGSLRLSCAASGFTFSSYAMNWVRQAPGKGLEWVSTISGGGANTYYADSVKGRFTISSDNSKSTLYLQMNSLRAEDTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 766 - protein, 451 aa, artificial; identical to SEQ ID NO: 765
  HC [hu anti-<huCDH19> 22G10.1 (1-470)(A99E) VH]::huIgG1z

SEQ ID NO: 767 - protein, 451 aa, artificial
  HC [hu anti-<huCDH19> 22G10.1 (1-470)(D72E,A99E) VH]::huIgG1z
EVQLLESGGGLVQPGGSLRLSCAASGFTFSSYAMNWVRQAPGKGLEWVSTISGGGANTYYAESVKGRFTISSDNSKSTLYLQMNSLRAEDTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 768 - protein, 451 aa, artificial
  HC [hu anti-<huCDH19> 22G10.1 (1-470)(H105Y) VH]::huIgG1z
EVQLLESGGGLVQPGGSLRLSCAASGFTFSSYAMNWVRQAPGKGLEWVSTISGGGANTYYADSVKGRFTISSDNSKSTLYLQMNSLRAADTAVYYCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 769 - protein, 455 aa, artificial
  HC [hu anti-<huCDH19> 16A4.1 (1-474)(T144L) VH]::huIgG1z
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 770 - protein, 450 aa, artificial; identical to SEQ ID NO: 658
  HC [hu anti-<huCDH19> 19B5.1 VH]::huIgG1z

SEQ ID NO: 771 - protein, 450 aa, artificial
  HC [hu anti-<huCDH19> 19B5.1 (1-469)(W133Y) VH]::huIgG1z
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 772 - protein, 450 aa, artificial; identical to SEQ ID NO: 658
  HC [hu anti-<huCDH19> 19B5.1 VH]::huIgG1z

SEQ ID NO: 773 - protein, 450 aa, artificial; identical to SEQ ID NO: 658
  HC [hu anti-<huCDH19> 19B5.1 VH]::huIgG1z

SEQ ID NO: 774 - protein, 450 aa, artificial; identical to SEQ ID NO: 771
  HC [hu anti-<huCDH19> 19B5.1 (1-469)(W133Y) VH]::huIgG1z

SEQ ID NO: 775 - protein, 455 aa, artificial
  HC [hu anti-<huCDH19> 23A10.3 (1-474)(L92Q) VH]::huIgG1z
QVQLVESGGGVVQPGRSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 776 - protein, 455 aa, artificial
  HC [hu anti-<huCDH19> 23A10.3 (1-474)(R17G,L92Q) VH]::huIgG1z
QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 777 - protein, 455 aa, artificial
  HC [hu anti-<huCDH19> 23A10.3 (1-474)(R17G,D61E,D72E,L92Q) VH]::huIgG1z
QVQLVESGGGVVQPGGSLRLSCAASGFTFSRYGIHWVRQAPGKGLEWVAVIWYEGSNKYYAESVKGRFTISRDNSKNTLYLQMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 778 - protein, 455 aa, artificial; identical to SEQ ID NO: 666
  HC [hu anti-<huCDH19> 23A10.3 VH]::huIgG1z

SEQ ID NO: 779 - protein, 450 aa, artificial; identical to SEQ ID NO: 723
  HC [hu anti-<huCDH19> 25G10.1 VH]::huIgG1z

SEQ ID NO: 780 - protein, 450 aa, artificial
  HC [hu anti-<huCDH19> 25G10.1 (1-469)(D109E,W132Y,W135Y) VH]::huIgG1z
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCAREGSSGYYRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 781 - protein, 450 aa, artificial; identical to SEQ ID NO: 672
  HC [hu anti-<huCDH19> 26D1.1 VH]::huIgG1z

SEQ ID NO: 782 - protein, 450 aa, artificial; identical to SEQ ID NO: 672
  HC [hu anti-<huCDH19> 26D1.1 VH]::huIgG1z

SEQ ID NO: 783 - protein, 450 aa, artificial; identical to SEQ ID NO: 672
  HC [hu anti-<huCDH19> 26D1.1 VH]::huIgG1z

SEQ ID NO: 784 - protein, 450 aa, artificial; identical to SEQ ID NO: 672
  HC [hu anti-<huCDH19> 26D1.1 VH]::huIgG1z

SEQ ID NO: 785 - protein, 450 aa, artificial
  HC [hu anti-<huCDH19> 26D1.1 (1-469)(W133Y) VH]::huIgG1z
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 786 - protein, 450 aa, artificial
  HC [hu anti-<huCDH19> 26D1.1 (1-469)(R27G,G82R) VH]::huIgG1z
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 787 - protein, 450 aa, artificial; identical to SEQ ID NO: 674
  HC [hu anti-<huCDH19> 26F12.1 VH]::huIgG1z

SEQ ID NO: 788 - protein, 450 aa, artificial; identical to SEQ ID NO: 674
  HC [hu anti-<huCDH19> 26F12.1 VH]::huIgG1z

SEQ ID NO: 789 - protein, 450 aa, artificial
  HC [hu anti-<huCDH19> 26F12.1 (1-469)(W133Y) VH]::huIgG1z
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 790 - protein, 450 aa, artificial; identical to SEQ ID NO: 789
  HC [hu anti-<huCDH19> 26F12.1 (1-469)(W133Y) VH]::huIgG1z

SEQ ID NO: 791 - protein, 450 aa, artificial; identical to SEQ ID NO: 668
  HC [hu anti-<huCDH19> 25F8.1 VH]::huIgG1z

SEQ ID NO: 792 - protein, 450 aa, artificial; identical to SEQ ID NO: 668
  HC [hu anti-<huCDH19> 25F8.1 VH]::huIgG1z

SEQ ID NO: 793 - protein, 450 aa, artificial
  HC [hu anti-<huCDH19> 25F8.1 (1-469)(F90Y) VH]::huIgG1z
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 794 - protein, 450 aa, artificial; identical to SEQ ID NO: 793
  HC [hu anti-<huCDH19> 25F8.1 (1-469)(F90Y) VH]::huIgG1z

SEQ ID NO: 795 - protein, 450 aa, artificial
  HC [hu anti-<huCDH19> 25F8.1 (1-469)(F90Y,W133Y) VH]::huIgG1z
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 796 - protein, 450 aa, artificial; identical to SEQ ID NO: 662
  HC [hu anti-<huCDH19> 22D1.1 VH]::huIgG1z

SEQ ID NO: 797 - protein, 450 aa, artificial; identical to SEQ ID NO: 662
  HC [hu anti-<huCDH19> 22D1.1 VH]::huIgG1z

SEQ ID NO: 798 - protein, 450 aa, artificial
  hu anti-<huCDH19> 22D1.1 (1-469)(W133Y) VH]::huIgG1z
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 799 - protein, 450 aa, artificial; identical to SEQ ID NO: 798
  HC [hu anti-<huCDH19> 22D1.1 (1-469)(W133Y) VH]::huIgG1z

SEQ ID NO: 800 - protein, 450 aa, artificial
  HC [hu anti-<huCDH19> 22D1.1 (1-469)(F90Y) VH]::huIgG1z
QVQLVQSGAEVKKPGASVRVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 801 - protein, 446 aa, artificial; identical to SEQ ID NO: 650
  HC [hu anti-<huCDH19> 4F7 VH]::huIgG1z

SEQ ID NO: 802 - protein, 455 aa, artificial; identical to SEQ ID NO: 640
  HC [hu anti-<huCDH19> 2G6 VH]::huIgG1z

SEQ ID NO: 803 - protein, 455 aa, artificial
  HC [hu anti-<huCDH19> 2G6 (1-477)(R17G,K94N) VH]::huIgG1z
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 804 - protein, 455 aa, artificial
  HC [hu anti-<huCDH19> 2G6 (1-477)(D61E,D72E) VH]::huIgG1z
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 805 - protein, 455 aa, artificial
  HC [hu anti-<huCDH19> 2G6 (1-477)(R17G) VH]::huIgG1z
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 806 - protein, 214 aa, artificial; identical to SEQ ID NO: 684
  LC [hu anti-<huCDH19> 4F3 VL]::huKLC

SEQ ID NO: 807 - protein, 217 aa, artificial; identical to SEQ ID NO: 680
  LC [hu anti-<huCDH19> 4A9 VL]::huLLC-C1

SEQ ID NO: 808 - protein, 214 aa, artificial; identical to SEQ ID NO: 682
  LC [hu anti-<huCDH19> 4B10 VL]::huKLC

SEQ ID NO: 809 - protein, 215 aa, artificial; identical to SEQ ID NO: 692
  LC [hu anti-<huCDH19> 17H8.2 VL]::huKLC

SEQ ID NO: 810 - protein, 215 aa, artificial; identical to SEQ ID NO: 690
  LC [hu anti-<huCDH19> 16C1.1 VL]::huKLC

SEQ ID NO: 811 - protein, 215 aa, artificial; identical to SEQ ID NO: 688
  LC [hu anti-<huCDH19> 16A4.1 VL]::huKLC

SEQ ID NO: 812 - protein, 214 aa, artificial; identical to SEQ ID NO: 700
  LC [hu anti-<huCDH19> 22G10.1 VL]::huKLC

SEQ ID NO: 813 - protein, 216 aa, artificial; identical to SEQ ID NO: 696
  LC [hu anti-<huCDH19> 20D3.1 VL]::huLLC-C2

SEQ ID NO: 814 - protein, 216 aa, artificial; identical to SEQ ID NO: 698
  LC [hu anti-<huCDH19> 22D1.1 VL]::huLLC-C2

SEQ ID NO: 815 - protein, 216 aa, artificial; identical to SEQ ID NO: 704
  LC [hu anti-<huCDH19> 25F8.1 VL]::huLLC-C2

SEQ ID NO: 816 - protein, 216 aa, artificial; identical to SEQ ID NO: 710
  LC [hu anti-<huCDH19> 26F12.1 VL]::huLLC-C2

SEQ ID NO: 817 - protein, 216 aa, artificial; identical to SEQ ID NO: 708
  LC [hu anti-<huCDH19> 26D1.1 VL]::huLLC-C2

SEQ ID NO: 818 - protein, 215 aa, artificial; identical to SEQ ID NO: 706
  LC [hu anti-<huCDH19> 25G10.1 VL]::huKLC

SEQ ID NO: 819 - protein, 216 aa, artificial; identical to SEQ ID NO: 694
  LC [hu anti-<huCDH19> 19B5.1 VL]::huLLC-C2

SEQ ID NO: 820 - protein, 214 aa, artificial
  LC [hu anti-<huCDH19> 4A2 (1-236)(N30Q) VL]::huKLC
EIVLTQSPGTLSLSPGERATLSCRASRQISSSYLAWYQQKPGQAPRLLIYGPSSRATGIPDRFSGSGSGTDFTLTISRLEPEDFTVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 821 - protein, 214 aa, artificial
  LC [hu anti-<huCDH19> 4A2 (1-236)(N30Q,T102A,P141Q) VL]::huKLC
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 822 - protein, 214 aa, artificial
  LC [hu anti-<huCDH19> 4A2 (1-236)(N30Q,T102A) VL]::huKLC
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 823 - protein, 214 aa, artificial; identical to SEQ ID NO: 822
  LC [hu anti-<huCDH19> 4A2 (1-236)(N30Q,T102A) VL]::huKLC

SEQ ID NO: 824 - protein, 214 aa, artificial; identical to SEQ ID NO: 821
  LC [hu anti-<huCDH19> 4A2 (1-236)(N30Q,T102A,P141Q) VL]::huKLC

SEQ ID NO: 825 - protein, 214 aa, artificial; identical to SEQ ID NO: 821
  LC [hu anti-<huCDH19> 4A2 (1-236)(N30Q,T102A,P141Q) VL]::huKLC

SEQ ID NO: 826 - protein, 214 aa, artificial
  LC [hu anti-<huCDH19> 4A2 (1-236)(R29Q,N30S) VL]::huKLC
EIVLTQSPGTLSLSPGERATLSCRASQSISSSYLAWYQQKPGQAPRLLIYGPSSRATGIPDRFSGSGSGTDFTLTISRLEPEDFTVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 827 - protein, 214 aa, artificial; identical to SEQ ID NO: 684
  LC [hu anti-<huCDH19> 4F3 VL]::huKLC

SEQ ID NO: 828 - protein, 214 aa, artificial; identical to SEQ ID NO: 684
  LC [hu anti-<huCDH19> 4F3 VL]::huKLC

SEQ ID NO: 829 - protein, 214 aa, artificial; identical to SEQ ID NO: 684
  LC [hu anti-<huCDH19> 4F3 VL]::huKLC

SEQ ID NO: 830 - protein, 214 aa, artificial; identical to SEQ ID NO: 684
  LC [hu anti-<huCDH19> 4F3 VL]::huKLC

SEQ ID NO: 831 - protein, 214 aa, artificial; identical to SEQ ID NO: 684
  LC [hu anti-<huCDH19> 4F3 VL]::huKLC

SEQ ID NO: 832 - protein, 212 aa, artificial
  LC [hu anti-<huCDH19> 2G6 (1-234)(C42S,D110E) VL]::huLLC-C1
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 833 - protein, 215 aa, artificial
  LC [hu anti-<huCDH19> 16C1.1 (1-235)(H105Y) VL]::huKLC
EIVLTQSPGTLSLSPGERATLSCRASQSVSSSYLAWYQQKPGQAPRLLIFGASSRATGIPDRFSGSGSGTDFTLTISGLEPEDFAVYYCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 834 - protein, 215 aa, artificial; identical to SEQ ID NO: 833
  LC [hu anti-<huCDH19> 16C1.1 (1-235)(H105Y) VL]::huKLC

SEQ ID NO: 835 - protein, 215 aa, artificial; identical to SEQ ID NO: 833
  LC [hu anti-<huCDH19> 16C1.1 (1-235)(H105Y) VL]::huKLC

SEQ ID NO: 836 - protein, 215 aa, artificial; identical to SEQ ID NO: 833
  LC [hu anti-<huCDH19> 16C1.1 (1-235)(H105Y) VL]::huKLC

SEQ ID NO: 837 - protein, 215 aa, artificial
  LC [hu anti-<huCDH19> 16C1.1 (1-235)(G95R,H105Y,G141Q) VL]::huKLC
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 838 - protein, 215 aa, artificial
  LC [hu anti-<huCDH19> 17H8.2 (1-235)(G149R) VL]::huKLC
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 839 - protein, 215 aa, artificial; identical to SEQ ID NO: 838
  LC [hu anti-<huCDH19> 17H8.2 (1-235)(G149R) VL]::huKLC

SEQ ID NO: 840 - protein, 215 aa, artificial; identical to SEQ ID NO: 838
  LC [hu anti-<huCDH19> 17H8.2 (1-235)(G149R) VL]::huKLC

SEQ ID NO: 841 - protein, 215 aa, artificial
  LC [hu anti-<huCDH19> 17H8.2 (1-235)(S57Y,G149R) VL]::huKLC
DIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 842 - protein, 217 aa, artificial
  LC [hu anti-<huCDH19> 4F7 (1-239)(H57Y) VL]::huLLC-C2
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 843 - protein, 217 aa, artificial
  LC [hu anti-<huCDH19> 4F7 (1-239)(H57Y,D110E) VL]::huLLC-C2
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYESSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 844 - protein, 217 aa, artificial
  LC [hu anti-<huCDH19> 4F7 (1-239)(D110E) VL]::huLLC-C2
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYESSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 845 - protein, 214 aa, artificial
  LC [hu anti-<huCDH19> 4B10 (1-236)(H45Q,A90T) VL]::huKLC
EIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 846 - protein, 214 aa, artificial; identical to SEQ ID NO: 845
  LC [hu anti-<huCDH19> 4B10 (1-236)(H45Q,A90T) VL]::huKLC

SEQ ID NO: 847 - protein, 214 aa, artificial; identical to SEQ ID NO: 845
  LC [hu anti-<huCDH19> 4B10 (1-236)(H45Q,A90T) VL]::huKLC

SEQ ID NO: 848 - protein, 214 aa, artificial; identical to SEQ ID NO: 845
  LC [hu anti-<huCDH19> 4B10 (1-236)(H45Q,A90T) VL]::huKLC

SEQ ID NO: 849 - protein, 217 aa, artificial
  LC [hu anti-<huCDH19> 4A9 (1-239)(F47L) VL]::huLLC-C1
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 850 - protein, 217 aa, artificial; identical to SEQ ID NO: 849
  LC [hu anti-<huCDH19> 4A9 (1-239)(F47L) VL]::huLLC-C1

SEQ ID NO: 851 - protein, 217 aa, artificial
  LC [hu anti-<huCDH19> 4A9 (1-239)(F47L,D110E) VL]::huLLC-C1
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYESRLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 852 - protein, 217 aa, artificial; identical to SEQ ID NO: 851
  LC [hu anti-<huCDH19> 4A9 (1-239)(F47L,D110E) VL]::huLLC-C1

SEQ ID NO: 853 - protein, 216 aa, artificial
  LC [hu anti-<huCDH19> 20D3.1 (1-235)(S102A) VL]::huLLC-C2
QSALTQPPSATGTPGQRVTISCSGSSSNIGSNFVNWYKQLPGTAPKVLIYTNNQRPSGVPDRFSGSKSGTSASLAISGLQSEDEADYYCATWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 854 - protein, 216 aa, artificial
  LC [hu anti-<huCDH19> 20D3.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 855 - protein, 216 aa, artificial; identical to SEQ ID NO: 854
  LC [hu anti-<huCDH19> 20D3.1 (1-235)(K45Q,S102A) VL]::huLLC-C2

SEQ ID NO: 856 - protein, 216 aa, artificial
  LC [hu anti-<huCDH19> 20D3.1 (1-235)(K45Q,S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 857 - protein, 216 aa, artificial
  LC [hu anti-<huCDH19> 20D3.1 (1-235)(W109Y) VL]::huLLC-C2
QSALTQPPSATGTPGQRVTISCSGSSSNIGSNFVNWYKQLPGTAPKVLIYTNNQRPSGVPDRFSGSKSGTSASLAISGLQSEDESDYYCATYDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 858 - protein, 214 aa, artificial; identical to SEQ ID NO: 700
  LC [hu anti-<huCDH19> 22G10.1 VL]::huKLC

SEQ ID NO: 859 - protein, 214 aa, artificial; identical to SEQ ID NO: 700
  LC [hu anti-<huCDH19> 22G10.1 VL]::huKLC

SEQ ID NO: 860 - protein, 214 aa, artificial
  LC [hu anti-<huCDH19> 22G10.1 (1-234)(Q97E,S98P) VL]::huKLC
EIVMTQSPVTLSLSLGERATLSCRASQSISSNLAWFQQKPGQAPRLLIYGAFTRATGIPARVSGSGSGTEFTLTISSLEPEDFAVYYCQQYNYWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 861 - protein, 214 aa, artificial
  LC [hu anti-<huCDH19> 22G10.1 (1-234)(V78F,Q97E,S98P) VL]::huKLC
EIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 862 - protein, 214 aa, artificial; identical to SEQ ID NO: 861
  LC [hu anti-<huCDH19> 22G10.1 (1-234)(V78F,Q97E,S98P) VL]::huKLC

SEQ ID NO: 863 - protein, 214 aa, artificial; identical to SEQ ID NO: 700
  LC [hu anti-<huCDH19> 22G10.1 VL]::huKLC

SEQ ID NO: 864 - protein, 215 aa, artificial
  LC [hu anti-<huCDH19> 16A4.1 (1-235)(G141Q) VL]::huKLC
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 865 - protein, 216 aa, artificial
  LC [hu anti-<huCDH19> 19B5.1 (1-235)(K45Q,S102A) VL]::huLLC-C2
QSALTQPPSTTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 866 - protein, 216 aa, artificial; identical to SEQ ID NO: 865
  LC [hu anti-<huCDH19> 19B5.1 (1-235)(K45Q,S102A) VL]::huLLC-C2

SEQ ID NO: 867 - protein, 216 aa, artificial
  LC [hu anti-<huCDH19> 19B5.1 (1-235)(T11V,K45Q,S102A) VL]::huLLC-C2
QSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 868 - protein, 216 aa, artificial
  LC [hu anti-<huCDH19> 19B5.1 (1-235)(T11V,K45Q,S102A,D111E,N135Q) VL]::huLLC-C2
QSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 869 - protein, 216 aa, artificial
  LC [hu anti-<huCDH19> 19B5.1 (1-235)(T11V,K45Q,S102A,W109Y,D111E,N135Q) VL]::huLLC-C2
QSALTQPPSVTGTPGQRVTISCSGSRSNIGSNFVNWYQQLPGTAPKVLIYTNNQRPSGVPDRFSGSKSGTSASLAISGLQSEDEADYYCATYDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 870 - protein, 212 aa, artificial
  LC [hu anti-<huCDH19> 23A10.3 (1-231)(C42S) VL]::huLLC-C2
SYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 871 - protein, 212 aa, artificial; identical to SEQ ID NO: 870
  LC [hu anti-<huCDH19> 23A10.3 (1-231)(C42S) VL]::huLLC-C2

SEQ ID NO: 872 - protein, 212 aa, artificial
  LC [hu anti-<huCDH19> 23A10.3 (1-231)(C42S,D110E) VL]::huLLC-C2
SYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 873 - protein, 212 aa, artificial
  LC [hu anti-<huCDH19> 23A10.3 (1-231)(C42Y) VL]::huLLC-C2
SYELTQPPSVSVSPGQTASITCSGDRLGEKYVYWYQQKPGQSPILVIYQDNKWPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 874 - protein, 215 aa, artificial
  LC [hu anti-<huCDH19> 25G10.1 (1-235)(H105Y) VL]::huKLC
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 875 - protein, 215 aa, artificial; identical to SEQ ID NO: 874
  LC [hu anti-<huCDH19> 25G10.1 (1-235)(H105Y) VL]::huKLC

SEQ ID NO: 876 - protein, 216 aa, artificial
  LC [hu anti-<huCDH19> 26D1.1 (1-235)(S7P) VL]::huLLC-C2
HSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 877 - protein, 216 aa, artificial
  LC [hu anti-<huCDH19> 26D1.1 (1-235)(H1Q,S7P) VL]::huLLC-C2
QSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 878 - protein, 216 aa, artificial
  LC [hu anti-<huCDH19> 26D1.1 (1-235)(H1Q,S7P,W109Y) VL]::huLLC-C2
QSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 879 - protein, 216 aa, artificial
  LC [hu anti-<huCDH19> 26D1.1 (1-235)(H1Q,S7P,W109Y,D111E,N135Q) VL]::huLLC-C2
QSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 880 - protein, 216 aa, artificial; identical to SEQ ID NO: 879
  LC [hu anti-<huCDH19> 26D1.1 (1-235)(H1Q,S7P,W109Y,D111E,N135Q) VL]::huLLC-C2

SEQ ID NO: 881 - protein, 216 aa, artificial; identical to SEQ ID NO: 877
  LC [hu anti-<huCDH19> 26D1.1 (1-235)(H1Q,S7P) VL]::huLLC-C2

SEQ ID NO: 882 - protein, 216 aa, artificial
  LC [hu anti-<huCDH19> 26F12.1 (1-235)(S7P) VL]::huLLC-C2
QSVLTQPPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 883 - protein, 216 aa, artificial
  LC [hu anti-<huCDH19> 26F12.1 (1-235)(S7P,D111E) VL]::huLLC-C2
QSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 884 - protein, 216 aa, artificial; identical to SEQ ID NO: 883
  LC [hu anti-<huCDH19> 26F12.1 (1-235)(S7P,D111E) VL]::huLLC-C2

SEQ ID NO: 885 - protein, 216 aa, artificial
  LC [hu anti-<huCDH19> 26F12.1 (1-235)(S7P,W109Y,D111E,N135Q) VL]::huLLC-C2
QSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 886 - protein, 216 aa, artificial
  LC [hu anti-<huCDH19> 25F8.1 (1-235)(K45Q) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDESDYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 887 - protein, 216 aa, artificial
  LC [hu anti-<huCDH19> 25F8.1 (1-235)(K45Q,S102A) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDEADYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 888 - protein, 216 aa, artificial; identical to SEQ ID NO: 887
  LC [hu anti-<huCDH19> 25F8.1 (1-235)(K45Q,S102A) VL]::huLLC-C2

SEQ ID NO: 889 - protein, 216 aa, artificial
  LC [hu anti-<huCDH19> 25F8.1 (1-235)(K45Q,S102A,D111E) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 890 - protein, 216 aa, artificial
  LC [hu anti-<huCDH19> 25F8.1 (1-235)(K45Q,S102A,D111E,N135Q) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 891 - protein, 216 aa, artificial
  LC [hu anti-<huCDH19> 22D1.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 892 - protein, 216 aa, artificial
  LC [hu anti-<huCDH19> 22D1.1 (1-235)(K45Q,S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 893 - protein, 216 aa, artificial
  LC [hu anti-<huCDH19> 22D1.1 (1-235)(K45Q,S102A,W109Y,D111E,N135Q) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATYDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 894 - protein, 216 aa, artificial
  LC [hu anti-<huCDH19> 22D1.1 (1-235)(K45Q,S102A,W109Y) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATYDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 895 - protein, 216 aa, artificial; identical to SEQ ID NO: 891
  LC [hu anti-<huCDH19> 22D1.1 (1-235)(K45Q,S102A) VL]::huLLC-C2

SEQ ID NO: 896 - protein, 217 aa, artificial; identical to SEQ ID NO: 686
  LC [hu anti-<huCDH19> 4F7 VL]::huLLC-C1

SEQ ID NO: 897 - protein, 212 aa, artificial
  LC [hu anti-<huCDH19> 2G6 (1-234)(D110E) VL]::huLLC-C1
SYELTQPPSVSVSPGQTASITCSGDRLGEKYTCWYQQRPGQSPLLVIYQDTKRPSGIPERFSGSNSGNTATLTISGTQAMDEADYYCQAWESSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 898 - protein, 212 aa, artificial; identical to SEQ ID NO: 832
  LC [hu anti-<huCDH19> 2G6 (1-234)(C42S,D110E) VL]::huLLC-C1

SEQ ID NO: 899 - protein, 212 aa, artificial; identical to SEQ ID NO: 832
  LC [hu anti-<huCDH19> 2G6 (1-234)(C42S,D110E) VL]::huLLC-C1

SEQ ID NO: 900 - protein, 212 aa, artificial; identical to SEQ ID NO: 870
  LC [hu anti-<huCDH19> 23A10.3 (1-231)(C42S) VL]::huLLC-C2

SEQ ID NO: 901 - protein, 17 aa, artificial
  14039, 14303 - CDR-H2
FIWYEGSNKYYAESVKD

SEQ ID NO: 902 - protein, 10 aa, artificial
  14027 - CDR-H3
EGSSGWYFQY

SEQ ID NO: 903 - protein, 10 aa, artificial
  CDR-H3
EGSSGYYFQY

SEQ ID NO: 904 - protein, 8 aa, artificial
  14059 - CDR-H3
NYAFHFDF

SEQ ID NO: 905 - protein, 17 aa, artificial
  CDR-H2
VISYEGTNEYYAESVKG

SEQ ID NO: 906 - protein, 10 aa, artificial
  CDR-H3
ERYFDYSFDY

SEQ ID NO: 907 - protein, 17 aa, artificial
  CDR-H2
VIWYEGSNKYYAESVRG

SEQ ID NO: 908 - protein, 10 aa, artificial
  CDR-H3
ETGEGYYFDL

SEQ ID NO: 909 - protein, 8 aa, artificial
  CDR-H3
NYAFHFDY

SEQ ID NO: 910 - protein, 14 aa, artificial
  CDR-H3
ESRYRSGWYDAFDI

SEQ ID NO: 911 - protein, 14 aa, artificial
  CDR-H3
ESRYRSGYYDAFDI

SEQ ID NO: 912 - protein, 12 aa, artificial
  CDR-H3
EGSSGWYRWFDP

SEQ ID NO: 913 - protein, 12 aa, artificial
  CDR-H3
DGSSGYYRYFDP

SEQ ID NO: 914 - protein, 17 aa, artificial
  CDR-H2
TISGGGANTYYAESVKG

SEQ ID NO: 915 - protein, 11 aa, artificial
  CDR-H3
GGIQLYLHFDY

SEQ ID NO: 916 - protein, 11 aa, artificial
  CDR-H3
GGIQLYLHLDY

SEQ ID NO: 917 - protein, 11 aa, artificial
  CDR-H3
GGIQLYLHFDY

SEQ ID NO: 918 - protein, 11 aa, artificial
  CDR-H3
GGIQLYLHFDY

SEQ ID NO: 919 - protein, 11 aa, artificial
  CDR-H3
GGIKLYLHFDY

SEQ ID NO: 920 - protein, 12 aa, artificial
  CDR-H3
EGSSGYYRYFDP

SEQ ID NO: 921 - protein, 17 aa, artificial
  CDR-H2
VIWYEGSNKYYAESVKG

SEQ ID NO: 922 - protein, 11 aa, artificial
  CDR-L1
SGDRLGEKYTS

SEQ ID NO: 923 - protein, 9 aa, artificial
  CDR-L3
QAWESSTVV

SEQ ID NO: 924 - protein, 12 aa, artificial
  CDR-L1
RASRQISSSYLA

SEQ ID NO: 925 - protein, 12 aa, artificial
  CDR-L1
RASQSISSSYLA

SEQ ID NO: 926 - protein, 11 aa, artificial
  CDR-L3
QSYESRLSGWV

SEQ ID NO: 927 - protein, 11 aa, artificial
  CDR-L3
QSYESSLSGWV

SEQ ID NO: 928 - protein, 11 aa, artificial
  CDR-L3
ATWDESLQGWV

SEQ ID NO: 929 - protein, 11 aa, artificial
  CDR-L3
ATYDDSLNGWV

SEQ ID NO: 930 - protein, 11 aa, artificial
  CDR-L3
ATWDESMQGWV

SEQ ID NO: 931 - protein, 11 aa, artificial
  CDR-L3
ATYDESMQGWV

SEQ ID NO: 932 - protein, 11 aa, artificial
  CDR-L3
ATYDDSMNGWV

SEQ ID NO: 933 - protein, 11 aa, artificial
  CDR-L3
AAWDESLNGWV

SEQ ID NO: 934 - protein, 11 aa, artificial
  CDR-L3
AAWDESLQGWV

SEQ ID NO: 935 - protein, 11 aa, artificial
  CDR-L3
AVWDESLNGWV

SEQ ID NO: 936 - protein, 11 aa, artificial
  CDR-L3
AVYDESLQGWV

SEQ ID NO: 937 - protein, 11 aa, artificial
  CDR-L3
AVYDDSLNGWV

SEQ ID NO: 938 - protein, 11 aa, artificial
  CDR-L3
AVYDESLQGWV

SEQ ID NO: 939 - protein, 11 aa, artificial
  CDR-L1
SGDRLGEKYVS

SEQ ID NO: 940 - protein, 9 aa, artificial
  CDR-L3
QAWESSTVV

SEQ ID NO: 941 - protein, 11 aa, artificial
  CDR-L1
SGDRLGEKYVY

SEQ ID NO: 942 - protein, 11 aa, artificial
  CDR-L3
ATWDESMQGWV

SEQ ID NO: 943 - protein, 11 aa, artificial
  CDR-L3
ATYDESMQGWV

SEQ ID NO: 944 - protein, 772 aa, human
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 945 - DNA, 2319 bp, human
atgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattag

SEQ ID NO: 946 - protein, 772 aa, cynomolgus
MNCYLLLPFMLGIPLLWPCLGATENSQTKKVQQPVGSHLRVKRGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 947 - DNA, 2319 bp, cynomolgus
atgaattgttatttactgctgccttttatgttgggaattcctctcctatggccttgtcttggagcaacagaaaactctcaaacaaagaaagtccagcagccagtaggatctcatctgagagtgaagcgtggctgggtgtggaaccaattttttgtaccagaggaaatgaatacgactagtcatcacgttggccggctaagatctgatttagacaatggaaacaattctttccagtacaagcttttgggagctggagctggaagtacttttatcattgatgaaagaacaggtgacatatatgccatagagaagcttgatagagaggagcgatccctctacatcttaagagcccaggtaatagacatcactactggaagggctgtggaacctgagtctgagtttgtcatcaaagtttcggatatcaatgacaatgaaccaaaattcctagatgaaccttatgaggccattgtaccagagatgtctccagaaggaacattagtcatccaggtgacagcaagtgatgctgatgacccttcaagtggtaataatgctcgtctcctctacagcttattacaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacgagtgtattaattaaactttcagatgttaatgacaataagcctatatttaaagaaagtttataccgcctgacggtctctgaatctgcacccactgggacttctataggaacaatcatggcatatgataatgacataggagagaatgcagaaatggattacagcattgaagaggatgattcacagacatttgacattattactaatcatgaaactcaagaaggaatagttatattaaaaaagaaagtgaattttgagcaccagaaccactatggtattagagcaaaagttaaaaaccatcatgttgatgagcagctcatgaaataccacactgaagcttccaccactttcattaagatccaggtggaagatgttgatgagcctcctcttttcctccttccgtattacatatttgaaatttttgaagaaaccccacaaggatcatttgtaggcgtggtgtctgccacagacccagacaataggaaatctcctatcaggtattctattactaggagcaaagtgttcaatatcgatgataatggtacaatcactacaactaactcactggatcgggaaatcagtgcttggtacaacctaagtattacagccacagaaaaatacaatatagagcagatctcttcgatcccagtgtatgtgcaagttcttaatatcaatgatcatgctcctgagttctctcaatactatgagagttatgtttgtgaaaatgcaggctctggtcaggtaattcagactatcagtgcagtggatagagatgaatccatagaagagcaccatttttactttaatctatctgtagaagacactaactcttcaagttttacaatcatagacaatcaagataacacagctgtcattttgactaatagaactggttttaaccttcaagaagagcccatcttctacatctccatcttaattgccgacaatggaatcccgtcacttacaagtacaaacacccttaccatccatgtctgtgactgtgatgacagtgggagcacacagacctgccagtaccaggagcttatgctttccatgggattcaagacagaagtcatcattgctattctcatttgcattatggtaatatttgggtttatttttttgactttgggtttaaaacaacggagaaaacagattctatttcctgagaaaagtgaagatttcagagagaatatattccgatatgatgacgaagggggtggagaagaagatacagaggcctttgacgtagcagcgctgaggagtagcaccataatgcgggaacgcaagactcggaaaaccaccagcgctgagatcaggagcctatacaggcagtctttgcaagttggccccgacagtgccatattcaggaagttcatcctggaaaagctcgaagaagctgatactgatccgtgtgcccctccttttgattccctccagacctacgcttttgagggaacagggtcattagctggatccctgagctccttagaatcagctgtctctgatcaggatgaaagctatgattaccttaacgagttgggacctcgctttaaaagattagcatgcatgtttggttctgcagtgcagtcaaataattag

SEQ ID NO: 948 - protein, 596 aa, human
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTE

SEQ ID NO: 949 - DNA, 1788 bp, human
atgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaa

SEQ ID NO: 950 - protein, 624 aa, human
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQ

SEQ ID NO: 951 - DNA, 1872 bp, human
atgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacag

SEQ ID NO: 952 - protein, 729 aa, artificial
  huCDH19 (44-141) muCDH19 (140-770)
GWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 953 - DNA, 2190 bp, artificial
  huCDH19 (44-141) muCDH19 (140-770)
ggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaacccagattcctagatgaaccatatgaggccattgtacctgagatgtctccagaaggaacatttgtcatcaaggtgacagccaatgacgcagatgatccttcaactggctatcatgctcgcatcctatacaacttagaacgaggtcaaccatacttttctgttgagccaacaacaggagtcataaggatatcttctaagatggatagagagttgcaagatacatactgtgtaattattcaagccaaggacatgctcggtcagcctggagccttgtctggaacaacaaccgtatcaattaagctgtcagatattaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 954 - protein, 729 aa, artificial
  huCDH19 (44-249) muCDH19 (248-770)
GWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 955 - DNA, 2190 bp, artificial
  huCDH19 (44-249) muCDH19 (248-770)
ggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 956 - protein, 727 aa, artificial
  muCDH19 (44-139) huCDH19 (142-249) muCDH19 (248-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 957 - DNA, 2184 bp, artificial
  muCDH19 (44-139) huCDH19 (142-249) muCDH19 (248-770)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 958 - protein, 727 aa, artificial
  muCDH19 (44-139) huCDH19 (142-364) muCDH19 (363-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 959 - DNA, 2184 bp, artificial
  C137847 muCDH19 (44-139) huCDH19 (142-364) muCDH19 (363-770)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 960 - protein, 727 aa, artificial
  C137911 muCDH19 (44-247) huCDH19 (250-364) muCDH19 (363-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 961 - DNA, 2184 bp, artificial
  C137911 muCDH19 (44-247) huCDH19 (250-364) muCDH19 (363-770)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaacccagattcctagatgaaccatatgaggccattgtacctgagatgtctccagaaggaacatttgtcatcaaggtgacagccaatgacgcagatgatccttcaactggctatcatgctcgcatcctatacaacttagaacgaggtcaaccatacttttctgttgagccaacaacaggagtcataaggatatcttctaagatggatagagagttgcaagatacatactgtgtaattattcaagccaaggacatgctcggtcagcctggagccttgtctggaacaacaaccgtatcaattaagctgtcagatattaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 962 - protein, 727 aa, artificial
  C137917 muCDH19 (44-362) huCDH19 (365-772)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 963 - protein, 2184 aa, artificial
  C137917 muCDH19 (44-362) huCDH19 (365-772)
GCCTGGGTGTGGAGACCATTTGTTGTTCTAGAAGAAATGGATGATATACAATGTGTTGGAAAGCTAAGATCTGACTTAGACAATGGAAACAACTCTTTCCAGTACAAGCTACTGGGGATTGGCGCTGGAAGCTTTAGCATTAATGAAAGAACAGGTGAAATATGTGCCATACAGAAGCTTGATAGAGAGGAAAAATCCCTCTACATTCTGAGAGCCCAGGTAATAGACACCACTATTGGGAAGGCTGTGGAAACTGAATCCGAGTTTGTCATCAGAGTTTTGGATATCAATGACAATGAACCCAGATTCCTAGATGAACCATATGAGGCCATTGTACCTGAGATGTCTCCAGAAGGAACATTTGTCATCAAGGTGACAGCCAATGACGCAGATGATCCTTCAACTGGCTATCATGCTCGCATCCTATACAACTTAGAACGAGGTCAACCATACTTTTCTGTTGAGCCAACAACAGGAGTCATAAGGATATCTTCTAAGATGGATAGAGAGTTGCAAGATACATACTGTGTAATTATTCAAGCCAAGGACATGCTCGGTCAGCCTGGAGCCTTGTCTGGAACAACAACCGTATCAATTAAGCTGTCAGATATTAATGACAACAAGCCAATATTCAAAGAAAGTTTCTACCGCTTCACTATATCTGAATCTGCACCCATTGGAACATCAATAGGGAAAATTATGGCATATGATGATGACATAGGGGAGAATGCAGAGATGGAGTACAGCATTGAAGATGATGATTCAAAAATATTTGACATAATCATTGACAATGACACCCAAGAAGGGATAGTTATACTTAAAAAGAAAGTTGATTTTGAGCAGCAGAGCTATTATGGCATTAGAGCTAAGGTTAAAAACTGCCATGTGGATGAAGAGCTTGCACCTGCCCATGTTAACGCTTCCACAACCTACATTAAAGTTCAAGTAGAAGATGAAGATGAGCCTCCTCTTTTCCTCCTTCCATATTATGTATTTGAAGTTTTTGAAGAAACCCCACAGGGATCATTTGTAGGCGTGGTGTCTGCCACAGACCCAGACAATAGGAAATCTCCTATCAGGTATTCTATTACTAGGAGCAAAGTGTTCAATATCAATGATAATGGTACAATCACTACAAGTAACTCACTGGATCGTGAAATCAGTGCTTGGTACAACCTAAGTATTACAGCCACAGAAAAATACAATATAGAACAGATCTCTTCGATCCCACTGTATGTGCAAGTTCTTAACATCAATGATCATGCTCCTGAGTTCTCTCAATACTATGAGACTTATGTTTGTGAAAATGCAGGCTCTGGTCAGGTAATTCAGACTATCAGTGCAGTGGATAGAGATGAATCCATAGAAGAGCACCATTTTTACTTTAATCTATCTGTAGAAGACACTAACAATTCAAGTTTTACAATCATAGATAATCAAGATAACACAGCTGTCATTTTGACTAATAGAACTGGTTTTAACCTTCAAGAAGAACCTGTCTTCTACATCTCCATCTTAATTGCCGACAATGGAATCCCGTCACTTACAAGTACAAACACCCTTACCATCCATGTCTGTGACTGTGGTGACAGTGGGAGCACACAGACCTGCCAGTACCAGGAGCTTGTGCTTTCCATGGGATTCAAGACAGAAGTCATCATTGCTATTCTCATTTGCATTATGATCATATTTGGGTTTATTTTTTTGACTTTGGGTTTAAAACAACGGAGAAAACAGATTCTATTTCCTGAGAAAAGTGAAGATTTCAGAGAGAATATATTCCAATATGATGATGAAGGGGGTGGAGAAGAAGATACAGAGGCCTTTGATATAGCAGAGCTGAGGAGTAGTACCATAATGCGGGAACGCAAGACTCGGAAAACCACAAGCGCTGAGATCAGGAGCCTATACAGGCAGTCTTTGCAAGTTGGCCCCGACAGTGCCATATTCAGGAAATTCATTCTGGAAAAGCTCGAAGAAGCTAATACTGATCCGTGTGCCCCTCCTTTTGATTCCCTCCAGACCTACGCTTTTGAGGGAACAGGGTCATTAGCTGGATCCCTGAGCTCCTTAGAATCAGCAGTCTCTGATCAGGATGAAAGCTATGATTACCTTAATGAGTTGGGACCTCGCTTTAAAAGATTAGCATGCATGTTTGGTTCTGCAGTGCAGTCAAATAATTAG

SEQ ID NO: 964 - protein, 727 aa, artificial
  C137915 muCDH19 (44-461) huCDH19 (464-772)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 965 - DNA, 2184 bp, artificial
  C137915 muCDH19 (44-461) huCDH19 (464-772)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaacccagattcctagatgaaccatatgaggccattgtacctgagatgtctccagaaggaacatttgtcatcaaggtgacagccaatgacgcagatgatccttcaactggctatcatgctcgcatcctatacaacttagaacgaggtcaaccatacttttctgttgagccaacaacaggagtcataaggatatcttctaagatggatagagagttgcaagatacatactgtgtaattattcaagccaaggacatgctcggtcagcctggagccttgtctggaacaacaaccgtatcaattaagctgtcagatattaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattag

SEQ ID NO: 966 - protein, 727 aa, artificial
  C71144 muCDH19 (44-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 967 - protein, 2184 aa, artificial
  C71144 muCDH19 (44-770)
GCCTGGGTGTGGAGACCATTTGTTGTTCTAGAAGAAATGGATGATATACAATGTGTTGGAAAGCTAAGATCTGACTTAGACAATGGAAACAACTCTTTCCAGTACAAGCTACTGGGGATTGGCGCTGGAAGCTTTAGCATTAATGAAAGAACAGGTGAAATATGTGCCATACAGAAGCTTGATAGAGAGGAAAAATCCCTCTACATTCTGAGAGCCCAGGTAATAGACACCACTATTGGGAAGGCTGTGGAAACTGAATCCGAGTTTGTCATCAGAGTTTTGGATATCAATGACAATGAACCCAGATTCCTAGATGAACCATATGAGGCCATTGTACCTGAGATGTCTCCAGAAGGAACATTTGTCATCAAGGTGACAGCCAATGACGCAGATGATCCTTCAACTGGCTATCATGCTCGCATCCTATACAACTTAGAACGAGGTCAACCATACTTTTCTGTTGAGCCAACAACAGGAGTCATAAGGATATCTTCTAAGATGGATAGAGAGTTGCAAGATACATACTGTGTAATTATTCAAGCCAAGGACATGCTCGGTCAGCCTGGAGCCTTGTCTGGAACAACAACCGTATCAATTAAGCTGTCAGATATTAATGACAACAAGCCAATATTCAAAGAAAGTTTCTACCGCTTCACTATATCTGAATCTGCACCCATTGGAACATCAATAGGGAAAATTATGGCATATGATGATGACATAGGGGAGAATGCAGAGATGGAGTACAGCATTGAAGATGATGATTCAAAAATATTTGACATAATCATTGACAATGACACCCAAGAAGGGATAGTTATACTTAAAAAGAAAGTTGATTTTGAGCAGCAGAGCTATTATGGCATTAGAGCTAAGGTTAAAAACTGCCATGTGGATGAAGAGCTTGCACCTGCCCATGTTAACGCTTCCACAACCTACATTAAAGTTCAAGTAGAAGATGAAGATGAACCTCCTGTTTTCCTCTTACCATATTACATACTTGAAATTCCTGAAGGAAAACCATATGGAACAATTGTGGGGACGGTTTCTGCCACAGACCCAGATCGAAGACAATCTCCTATGAGATATTATCTCACTGGAAGCAAAATGTTTGATATCAATGACAATGGAACAATAATCACCACTAACATGCTTGACAGAGAGGTCAGTGCTTGGTACAACTTGACTGTCACAGCTACTGAAACATACAATGTACAACAGATCTCTTCAGCCCATGTTTATGTACAAGTCTTTAACATTAACGACAATGCTCCAGAGTTCTCTCAATTCTATGAGACTTATGTTTGTGAAAATGCTGAATCTGGTGAGATAGTTCAGATCATCAGTGCAATTGATAGAGATGAGTCCATAGAAGATCACCATTTTTACTTTAATCACTCTCTGGAAGACACAAACAACTCAAGTTTTATGCTAACAGACAATCAAGATAACACAGCTGTAATTCTGAGTAATAGAACTGGTTTCAATCTTAAAGAAGAGCCTGTCTTCTACATGATCATCTTGATTGCTGATAACGGGATCCCATCTCTCACAAGCACAAACACTCTCACTATCCAAGTCTGTGACTGTGGAGACAGTAGAAACACAGAAACTTGTGCTAACAAGGGACTTCTCTTTATCATGGGATTCAGAACAGAGGCAATAATTGCCATCATGATATGTGTTATGGTAATATTTGGGTTTTTCTTTTTGATTCTTGCTCTGAAACAGCGAAGAAAGGAGACTCTATTTCCAGAGAAGACTGAAGACTTTAGGGAGAATATATTTTGCTATGATGATGAAGGCGGCGGGGAAGAAGACTCGGAAGCCTTTGACATCGTAGAGCTGAGACAAAGTACAGTAATGAGAGAAAGAAAGCCTCAGAGAAGCAAGAGTGCGGAGATCAGGAGCTTGTACAGGCAGTCCCTGCAGGTGGGCCCAGACAGTGCCATATTTCGAAAATTTATCCTAGAGAAGCTTGAAGAAGCCAACACAGACCCATGTGCTCCCCCCTTTGATTCACTACAGACGTTTGCCTATGAGGGAACAGGGTCATCAGCTGGCTCTCTGAGCTCCTTGGCATCCAGAGACACTGATCAGGAGGATGACTTCGACTACCTTAATGACCTGGGACCTCGTTTTAAAAGATTAGCAAGCATGTTTGGCTCTGCAGTACAACCCAACAATTAG

SEQ ID NO: 968 - protein, 8 aa, artificial
  Flag Tag
DYKDDDDK

SEQ ID NO: 969 - DNA, 24 bp, artificial
  Flag Tag
gactacaaagacgatgacgacaag

SEQ ID NO: 970 - protein, 784 aa, artificial
  ckCDH19(1-43)::FLAG::ckCDH19(44-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 971 - protein, 784 aa, artificial
  huCDH19(1-43)::FLAG::hu(44-141)::ckCDH19(142-776)
MNCYLLLRFMLGIPLLWPCLGATENSQTKKVKQPVRSHLRVKRDYKDDDDKGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 972 - protein, 784 aa, artificial
  ckCDH19(1-43)::FLAG::ckCDH19(44-141)::huCDH19(142-249)::ckCDH19(2 50-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 973 - protein, 784 aa, artificial
  ckCDH19(1-43)::FLAG::ckCDH19(44-249)::huCDH19(250-364)::ckCDH19(3 65-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 974 - protein, 779 aa, artificial
  ckCDH19(1-43)::FLAG::ckCDH19(44-364)::huCDH19(365-463)::ckCDH19(4 69-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 975 - protein, 785 aa, artificial
  (1-43)::FLAG::ckCDH19(44-468)::huCDH19(464-772)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 976 - protein, 780 aa, artificial
  rhCDH19(1-43)::FLAG::rhCDH19(44-772)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 977 - protein, 723 aa, artificial
  caCDH19(1-42)::FLAG::caCDH19(43-770)
QFFVPEEMNKTDYHIGQLRSDLDNGNNSFQYKLLGAGAGSIFVIDERTGDIYAIQKLDREERSLYTLRAQVIDSTTGRAVEPESEFVIRVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 978 - protein, 779 aa, artificial
  rhCDH19(1-43):FLAG::rhCDH19(44-141)::caCDH19(141-770)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 979 - protein, 779 aa, artificial
  rhCDH19(1-43)::FLAG::rhCDH19(44-65)::caCDH19(65-770)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSIFVIDERTGDIYAIQKLDREERSLYTLRAQVIDSTTGRAVEPESEFVIRVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 980 - protein, 778 aa, artificial
  caCDH19(1-43)::FLAG::caCDH19(44-87)::rhCDH19(89-114)::caCDH19(115 -770)
MNYCFLLPLMLGIPLIWPCFTASESSKTEVKHQAGSHLRVKRDYKDDDDKGWMWNQFFVPEEMNKTDYHIGQLRSDLDNGNNSFQYKLLGAGAGSTFIIDERTGDIYAIEKLDREERSLYILRAQVIDSTTGRAVEPESEFVIRVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 981 - protein, 778 aa, artificial
  caCDH19(1-43)::FLAG::caCDH19(44-120)::rhCDH19(122-137)::caCDH19(1 37-770)
MNYCFLLPLMLGIPLIWPCFTASESSKTEVKHQAGSHLRVKRDYKDDDDKGWMWNQFFVPEEMNKTDYHIGQLRSDLDNGNNSFQYKLLGAGAGSIFVIDERTGDIYAIQKLDREERSLYTLRAQVIDITTGRAVEPESEFVIKVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 982 - protein, 780 aa, artificial
  rhCDH19(1-43)::FLAG::rhCDH19(44-141)::raCDH19(140-247)::rhCDH19(2 50-772)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPRFLDEPYEAIVPEMSPEGTFVIKVTANDADDPTSGYHARILYNLEQGQPYFSVEPTTGVIRISSKMDRELQDTYCVIIQAKDMLGQPGALSGTTTISIKLSDINDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 983 - protein, 778 aa, artificial
  raCDH19(1-43)::FLAG::raCDH19(44-770)
MNHYFLKYWILMVPLIWPCLKVAETLKIEKAQRAVPSLGRAKRDYKDDDDKGWVWKQFVVPEEMDTIQHVGRLRSDLDNGNNSFQYKLLGTGDGSFSIDEKTGDIFAMQKLDREKQSLYILRAQVIDTTIGKAVEPESEFVIRVSDVNDNEPRFLDEPYEAIVPEMSPEGTFVIKVTANDADDPTSGYHARILYNLEQGQPYFSVEPTTGVIRISSKMDRELQDTYCVIIQAKDMLGQPGALSGTTTISIKLSDINDNKPIFKESFYRFTISESAPSGTTIGKIMAYDDDIGENAEMDYSIEDDESQIFDIVIDNETQEGIVILKKKVDFEHQNHYGIRVKVKNCHVDEELAPAHVNASTTYIKVQVEDEDEPPTFLLPYYIFEIPEGKPYGTMVGTVSAVDPDRRQSPMRYSLIGSKMFDINGNGTIVTTNLLDREVSAWYNLSVTATETYNVQQISSAHVYVQVLNINDHAPEFSQLYETYVCENAESGEIIQTISAIDRDESIEDHHFYFNHSVEDTNNSSFILTDNQDNTAVILSNRAGFSLKEETVFYMIILIADNGIPPLTSTNTLTIQVCDCGDSRSTETCTSKELLFIMGFKAEAIIAIVICVMVIFGFIFLILALKQRRKETLFPEKTEDFRENIFCYDDEGGGEEDSEAFDIIELRQSTVMRERKPRKSRSAEIRSLYRQSLQVGPDSAIFRKFILEKLEEANTDSSAPPFDSLQTFAYEGTGSSAGSLSSLGSSVTDQEDDFDYLNDLGPCFKRLANMFGSAVQPDN

SEQ ID NO: 984 - protein, 778 aa, artificial
  (1-43)::FLAG::muCDH19(44-323)::raCDH19(324-327)::muCDH19(328-770)
MNYCFLKHWILMIPLLWPCLKVSETLKAEKARRTVPSTWRAKRDYKDDDDKAWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEHQNHYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 985 - protein, 778 aa, artificial
  muCDH19(1-43)::FLAG::muCDH19(44-770)::raCDH19(290,299,308)
MNYCFLKHWILMIPLLWPCLKVSETLKAEKARRTVPSTWRAKRDYKDDDDKAWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 986 - protein, 778 aa, artificial
  muCDH19(1-43)::FLAG::muCDH19(44-770)::huCDH19(271)
MNYCFLKHWILMIPLLWPCLKVSETLKAEKARRTVPSTWRAKRDYKDDDDKAWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPTGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

The invention claimed is:

1. An isolated human antibody or antigen binding fragment thereof that binds to human cadherin 19 (CDH19) on the surface of a target cell, comprising a VH region comprising CDR-H1, CDR-H2 and CDR-H3 and a VL region comprising CDR-L1, CDR-L2 and CDR-L3 selected from the group consisting of:

(a) a VH region comprising CDR-H1 as depicted in SEQ ID NO: 4, CDR-H2 as depicted in SEQ ID NO: 5 and CDR-H3 as depicted in SEQ ID NO: 6, and a VL region comprising CDR-L1 as depicted in SEQ ID NO: 172, CDR-L2 as depicted in SEQ ID NO: 173 and CDR-L3 as depicted in SEQ ID NO: 174;

(b) a VH region comprising CDR-H1 as depicted in SEQ ID NO: 10, CDR-H2 as depicted in SEQ ID NO: 11 and CDR-H3 as depicted in SEQ ID NO: 12, and a VL region comprising CDR-L1 as depicted in SEQ ID NO: 178, CDR-L2 as depicted in SEQ ID NO: 179 and CDR-L3 as depicted in SEQ ID NO: 180;

(c) a VH region comprising CDR-H1 as depicted in SEQ ID NO: 28, CDR-H2 as depicted in SEQ ID NO: 29 and CDR-H3 as depicted in SEQ ID NO: 30, and a VL region comprising CDR-L1 as depicted in SEQ ID NO: 196, CDR-L2 as depicted in SEQ ID NO: 197 and CDR-L3 as depicted in SEQ ID NO: 198;

(d) a VH region comprising CDR-H1 as depicted in SEQ ID NO: 34, CDR-H2 as depicted in SEQ ID NO: 35, CDR-H3 as depicted in SEQ ID NO: 36, and a VL region comprising CDR-L1 as depicted in SEQ ID NO: 202, CDR-L2 as depicted in SEQ ID NO: 203 and CDR-L3 as depicted in SEQ ID NO: 204;

(e) a VH region comprising CDR-H1 as depicted in SEQ ID NO: 46, CDR-H2 as depicted in SEQ ID NO: 47 and CDR-H3 as depicted in SEQ ID NO: 48, and a VL region comprising CDR-L1 as depicted in SEQ ID NO: 214, CDR-L2 as depicted in SEQ ID NO: 215 and CDR-L3 as depicted in SEQ ID NO: 216;

(f) a VH region comprising CDR-H1 as depicted in SEQ ID NO: 58, CDR-H2 as depicted in SEQ ID NO: 59 and CDR-H3 as depicted in SEQ ID NO: 60, and a VL region comprising CDR-L1 as depicted in SEQ ID NO: 226, CDR-L2 as depicted in SEQ ID NO: 227 and CDR-L3 as depicted in SEQ ID NO: 228;

(g) a VH region comprising CDR-H1 as depicted in SEQ ID NO: 64, CDR-H2 as depicted in SEQ ID NO: 65 and CDR-H3 as depicted in SEQ ID NO: 66, and a VL region comprising CDR-L1 as depicted in SEQ ID NO: 232, CDR-L2 as depicted in SEQ ID NO: 233 and CDR-L3 as depicted in SEQ ID NO: 234;

(h) a VH region comprising CDR-H1 as depicted in SEQ ID NO: 70, CDR-H2 as depicted in SEQ ID NO: 71 and CDR-H3 as depicted in SEQ ID NO: 72, and a VL region comprising CDR-L1 as depicted in SEQ ID NO: 238, CDR-L2 as depicted in SEQ ID NO: 239 and CDR-L3 as depicted in SEQ ID NO: 240;

(i) a VH region comprising CDR-H1 as depicted in SEQ ID NO: 160, CDR-H2 as depicted in SEQ ID NO: 161 and CDR-H3 as depicted in SEQ ID NO: 162, and a VL region comprising CDR-L1 as depicted in SEQ ID NO: 328, CDR-L2 as depicted in SEQ ID NO: 329 and CDR-L3 as depicted in SEQ ID NO: 330;

(j) a VH region comprising CDR-H1 as depicted in SEQ ID NO: 46, CDR-H2 as depicted in SEQ ID NO: 47 and CDR-H3 as depicted in SEQ ID NO: 48, and a VL region comprising CDR-L1 as depicted in SEQ ID NO: 924, CDR-L2 as depicted in SEQ ID NO: 215 and CDR-L3 as depicted in SEQ ID NO: 216;

(k) a VH region comprising CDR-H1 as depicted in SEQ ID NO: 46, CDR-H2 as depicted in SEQ ID NO: 47 and CDR-H3 as depicted in SEQ ID NO: 902, and a VL region comprising CDR-L1 as depicted in SEQ ID NO: 924, CDR-L2 as depicted in SEQ ID NO: 215 and CDR-L3 as depicted in SEQ ID NO: 216;

(l) a VH region comprising CDR-H1 as depicted in SEQ ID NO: 46, CDR-H2 as depicted in SEQ ID NO: 47 and CDR-H3 as depicted in SEQ ID NO: 903, and a VL region comprising CDR-L1 as depicted in SEQ ID NO: 924, CDR-L2 as depicted in SEQ ID NO: 215 and CDR-L3 as depicted in SEQ ID NO: 216;

(m) a VH region comprising CDR-H1 as depicted in SEQ ID NO: 46, CDR-H2 as depicted in SEQ ID NO: 47 and CDR-H3 as depicted in SEQ ID NO: 48, and a VL region comprising CDR-L1 as depicted in SEQ ID NO: 925, CDR-L2 as depicted in SEQ ID NO: 215 and CDR-L3 as depicted in SEQ ID NO: 216;

(n) a VH region comprising CDR-H1 as depicted in SEQ ID NO: 70, CDR-H2 as depicted in SEQ ID NO: 907 and CDR-H3 as depicted in SEQ ID NO: 72, and a VL region comprising CDR-L1 as depicted in SEQ ID NO: 238, CDR-L2 as depicted in SEQ ID NO: 239 and CDR-L3 as depicted in SEQ ID NO: 240;

(o) a VH region comprising CDR-H1 as depicted in SEQ ID NO: 70, CDR-H2 as depicted in SEQ ID NO: 907 and CDR-H3 as depicted in SEQ ID NO: 908, and a VL region comprising CDR-L1 as depicted in SEQ ID NO: 238, CDR-L2 as depicted in SEQ ID NO: 239 and CDR-L3 as depicted in SEQ ID NO: 240;

(p) a VH region comprising CDR-H1 as depicted in SEQ ID NO: 28, CDR-H2 as depicted in SEQ ID NO: 901 and CDR-H3 as depicted in SEQ ID NO: 30, and a VL region comprising CDR-L1 as depicted in SEQ ID NO: 922, CDR-L2 as depicted in SEQ ID NO: 197 and CDR-L3 as depicted in SEQ ID NO: 923;

(q) a VH region comprising CDR-H1 as depicted in SEQ ID NO: 58, CDR-H2 as depicted in SEQ ID NO: 905 and CDR-H3 as depicted in SEQ ID NO: 906, and a VL region comprising CDR-L1 as depicted in SEQ ID NO: 226, CDR-L2 as depicted in SEQ ID NO: 227 and CDR-L3 as depicted in SEQ ID NO: 228;
(r) a VH region comprising CDR-H1 as depicted in SEQ ID NO: 58, CDR-H2 as depicted in SEQ ID NO: 905 and CDR-H3 as depicted in SEQ ID NO: 60, and a VL region comprising CDR-L1 as depicted in SEQ ID NO: 226, CDR-L2 as depicted in SEQ ID NO: 227 and CDR-L3 as depicted in SEQ ID NO: 228;
(s) a VH region comprising CDR-H1 as depicted in SEQ ID NO: 160, CDR-H2 as depicted in SEQ ID NO: 161 and CDR-H3 as depicted in SEQ ID NO: 162, and a VL region comprising CDR-L1 as depicted in SEQ ID NO: 939, CDR-L2 as depicted in SEQ ID NO: 329 and CDR-L3 as depicted in SEQ ID NO: 330;
(t) a VH region comprising CDR-H1 as depicted in SEQ ID NO: 160, CDR-H2 as depicted in SEQ ID NO: 921 and CDR-H3 as depicted in SEQ ID NO: 162, and a VL region comprising CDR-L1 as depicted in SEQ ID NO: 939, CDR-L2 as depicted in SEQ ID NO: 329 and CDR-L3 as depicted in SEQ ID NO: 940;
(u) a VH region comprising CDR-H1 as depicted in SEQ ID NO: 160, CDR-H2 as depicted in SEQ ID NO: 161 and CDR-H3 as depicted in SEQ ID NO: 162, and a VL region comprising CDR-L1 as depicted in SEQ ID NO: 941, CDR-L2 as depicted in SEQ ID NO: 329 and CDR-L3 as depicted in SEQ ID NO: 330;
(v) a VH region comprising CDR-H1 as depicted in SEQ ID NO: 28, CDR-H2 as depicted in SEQ ID NO: 29 and CDR-H3 as depicted in SEQ ID NO: 30, and a VL region comprising CDR-L1 as depicted in SEQ ID NO: 196, CDR-L2 as depicted in SEQ ID NO: 197 and CDR-L3 as depicted in SEQ ID NO: 923;
(w) a VH region comprising CDR-H1 as depicted in SEQ ID NO: 28, CDR-H2 as depicted in SEQ ID NO: 29 and CDR-H3 as depicted in SEQ ID NO: 30, and a VL region comprising CDR-L1 as depicted in SEQ ID NO: 922, CDR-L2 as depicted in SEQ ID NO: 197 and CDR-L3 as depicted in SEQ ID NO: 923; and
(x) a VH region comprising CDR-H1 as depicted in SEQ ID NO: 28, CDR-H2 as depicted in SEQ ID NO: 29 and CDR-H3 as depicted in SEQ ID NO: 30, and a VL region comprising CDR-L1 as depicted in SEQ ID NO: 939, CDR-L2 as depicted in SEQ ID NO: 329 and CDR-L3 as depicted in SEQ ID NO: 330.

2. The human antibody or antigen binding fragment thereof according to claim 1, wherein the antibody or antigen binding fragment thereof is a monoclonal antibody or a fragment thereof.

3. The human antibody or antigen binding fragment thereof according to claim 1, comprising a VH region comprising the amino acid sequence selected from the group consisting of:
SEQ ID NO: 352, SEQ ID NO: 360, SEQ ID NO: 388, SEQ ID NO: 386, SEQ ID NO: 340, SEQ ID NO: 346, SEQ ID NO: 374, SEQ ID NO: 348, SEQ ID NO: 390, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 488, SEQ ID NO: 489, SEQ ID NO: 490, SEQ ID NO: 491, SEQ ID NO: 513, SEQ ID NO: 514, SEQ ID NO: 515, SEQ ID NO: 516, SEQ ID NO: 540, SEQ ID NO: 541, SEQ ID NO: 542, and SEQ ID NO: 543.

4. The human antibody or antigen binding fragment thereof according to claim 1, comprising a VL region comprising the amino acid sequence selected from the group consisting of:
SEQ ID NO: 408, SEQ ID NO: 416, SEQ ID NO: 444, SEQ ID NO: 442, SEQ ID NO: 396, SEQ ID NO: 402, SEQ ID NO: 430, SEQ ID NO: 404, SEQ ID NO: 446, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 583, SEQ ID NO: 584, SEQ ID NO: 585, SEQ ID NO: 586, SEQ ID NO: 608, SEQ ID NO: 609, SEQ ID NO: 610, SEQ ID NO: 611, SEQ ID NO: 635, SEQ ID NO: 636, SEQ ID NO: 637, and SEQ ID NO: 638.

5. The human antibody or antigen binding fragment thereof according to claim 1, comprising a VH region and a VL region comprising a pair of amino acid sequences selected from the group consisting of:
SEQ ID NOs: 352 and 408, SEQ ID NOs: 360 and 416, SEQ ID NOs: 388 and 444, SEQ ID NOs: 386 and 442, SEQ ID NOs: 348 and 404, SEQ ID NOs: 390 and 446, SEQ ID NOs: 463 and 558, SEQ ID NOs: 464 and 559, SEQ ID NOs: 465 and 560, SEQ ID NOs: 466 and 561, SEQ ID NOs: 467 and 562, SEQ ID NOs: 468 and 563, SEQ ID NOs: 469 and 564, SEQ ID NOs: 470 and 565, SEQ ID NOs: 471 and 566, SEQ ID NOs: 472 and 567, SEQ ID NOs: 473 and 568, SEQ ID NOs: 474 and 569, SEQ ID NOs: 475 and 570, SEQ ID NOs: 488 and 583, SEQ ID NOs: 489 and 584, SEQ ID NOs: 490 and 585, SEQ ID NOs: 491 and 586, SEQ ID NOs: 513 and 608, SEQ ID NOs: 514 and 609, SEQ ID NOs: 515 and 610, SEQ ID NOs: 516 and 611, SEQ ID NOs: 540 and 635, SEQ ID NOs: 541 and 636, SEQ ID NOs: 542 and 637, and SEQ ID NOs: 543 and 638.

6. The human antibody or antigen binding fragment thereof according to claim 5, comprising a heavy and light chain amino acid sequence selected from the group consisting of:
SEQ ID NOs: 640 and 676, SEQ ID NOs: 642 and 678, SEQ ID NOs: 646 and 682, SEQ ID NOs: 648 and 684, SEQ ID NOs: 666 and 702, SEQ ID NOs: 725 and 820, SEQ ID NOs: 726 and 821, SEQ ID NOs: 727 and 822, SEQ ID NOs: 728 and 823, SEQ ID NOs: 729 and 824, SEQ ID NOs: 730 and 825, SEQ ID NOs: 731 and 826, SEQ ID NOs: 732 and 827, SEQ ID NOs: 733 and 828, SEQ ID NOs: 734 and 829, SEQ ID NOs: 735 and 830, SEQ ID NOs: 736 and 831, SEQ ID NOs: 737 and 832, SEQ ID NOs: 750 and 845, SEQ ID NOs: 751 and 846, SEQ ID NOs: 752 and 847, SEQ ID NOs: 753 and 848, SEQ ID NOs: 775 and 870, SEQ ID NOs: 776 and 871, SEQ ID NOs: 777 and 872, SEQ ID NOs: 778 and 873, SEQ ID NOs: 802 and 897, SEQ ID NOs: 803 and 898, SEQ ID NOs: 804 and 899, and SEQ ID NOs: 805 and 900.

7. An antibody construct comprising the human antibody or antigen binding fragment thereof according to claim 1 conjugated to a chemotherapeutic agent.

8. The antibody construct according to claim 7, further comprising a linker, wherein the linker conjugates the chemotherapeutic agent to the human antibody or antigen binding fragment thereof.

9. The antibody construct according to claim 8, wherein the linker is a non-cleavable linker.

10. The antibody construct according to claim 9, wherein the linker comprises N-succinimidyl 4-(N-maleimidomethyl) cyclohexane-1 carboxylate (MCC).

11. The antibody construct of claim 7, wherein the chemotherapeutic agent is conjugated to one or more lysines contained in the human antibody or antigen binding fragment thereof.

12. The antibody construct of claim 7, wherein the chemotherapeutic agent is a maytansinoid (DM1).

13. The antibody construct of claim 12, wherein the average number of DM1 molecules per antibody construct is between 1 and 10.

14. The antibody construct of claim 12, wherein the average number of DM1 molecules per antibody construct is between 3 and 7.

15. The antibody construct of claim 12, wherein the average number of DM1 molecules per antibody construct is between 4 and 6.

16. The antibody construct of claim 12, wherein the average number of DM1 molecules per antibody construct is about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0.

17. An isolated nucleic acid molecule encoding the human antibody or antigen binding fragment thereof of claim 1.

18. A vector comprising the nucleic acid molecule of claim 17.

19. A host cell transformed or transfected with the nucleic acid molecule of claim 17.

20. A process for the production of a human antibody or antigen binding fragment thereof, said process comprising culturing the host cell of claim 15 under conditions allowing the expression of the antibody or antigen binding fragment thereof.

21. The process of claim 20 further comprising recovering the produced antibody or antigen binding fragment thereof, and conjugating a chemotherapeutic agent to the recovered antibody or antigen binding fragment thereof to produce an antibody conjugate.

22. A pharmaceutical composition comprising the human antibody or antigen binding fragment thereof according to claim 1 and a pharmaceutically acceptable carrier thereof.

23. A method for treating or ameliorating a melanoma disease or metastatic melanoma disease, comprising administering to a subject in need thereof the antibody or antigen binding fragment thereof of claim 1.

24. The method according to claim 23, wherein the melanoma disease or metastatic melanoma disease is selected from the group consisting of superficial spreading melanoma, lentigo maligna, lentigo maligna melanoma, acral lentiginous melanoma and nodular melanoma.

25. A kit comprising the antibody or antigen binding fragment thereof of claim 1 in a vial or a syringe.

* * * * *